US008288096B2

(12) United States Patent
Petrou et al.

(10) Patent No.: US 8,288,096 B2
(45) Date of Patent: Oct. 16, 2012

(54) DIAGNOSTIC METHOD FOR EPILEPSY

(75) Inventors: Steven Petrou, Eltham (AU); Samuel Frank Berkovic, Caulfield (AU); Ingrid Eileen Scheffer, Hawthorn East (AU)

(73) Assignee: Bionomics Limited, Thebarton (AU)

( * ) Notice: Subject to any disclaimer, the term of this patent is extended or adjusted under 35 U.S.C. 154(b) by 0 days.

(21) Appl. No.: 12/767,523

(22) Filed: Apr. 26, 2010

(65) Prior Publication Data

US 2010/0203548 A1 Aug. 12, 2010

Related U.S. Application Data

(63) Continuation of application No. 10/806,899, filed on Mar. 23, 2004, now Pat. No. 7,723,027.

(30) Foreign Application Priority Data

Mar. 27, 2003 (AU) .............................. 2003901425

(51) Int. Cl.
*C12Q 1/68* (2006.01)
*C12P 19/34* (2006.01)
(52) U.S. Cl. ........................................ 435/6.1; 435/91.2
(58) Field of Classification Search .................. None
See application file for complete search history.

(56) References Cited

U.S. PATENT DOCUMENTS

| | | | |
|---|---|---|---|
| 4,016,043 A | 4/1977 | Schuurs et al. | |
| 4,172,124 A | 10/1979 | Koprowski et al. | |
| 4,474,893 A | 10/1984 | Reading | |
| 4,971,903 A | 11/1990 | Hyman | |
| 5,331,573 A | 7/1994 | Balaji et al. | |
| 5,579,250 A | 11/1996 | Balaji et al. | |
| 6,331,614 B1 | 12/2001 | Wong et al. | |
| 7,078,515 B2 | 7/2006 | Wallace et al. | |
| 7,282,336 B2 | 10/2007 | Wallace et al. | |
| 7,709,225 B2 | 5/2010 | Wallace et al. | |
| 8,129,142 B2 | 3/2012 | Mulley et al. | |
| 2003/0157525 A1 | 8/2003 | Mintier et al. | |
| 2004/0096886 A1 | 5/2004 | Rouleau et al. | |
| 2004/0110706 A1 | 6/2004 | Wallace et al. | |
| 2004/0214195 A1 | 10/2004 | Rouleau et al. | |
| 2004/0229257 A1 | 11/2004 | Petrou et al. | |
| 2005/0074764 A1 | 4/2005 | Mulley et al. | |
| 2006/0089306 A1 | 4/2006 | Wallace et al. | |
| 2006/0252121 A1 | 11/2006 | Wallace et al. | |
| 2010/0088778 A1 | 4/2010 | Mulley et al. | |

FOREIGN PATENT DOCUMENTS

| | | |
|---|---|---|
| AU | 656247 | 6/1996 |
| WO | WO84/03564 | 9/1984 |
| WO | WO97/02048 | 1/1997 |
| WO | WO 01/38564 | 5/2001 |
| WO | WO01/88125 | 11/2001 |
| WO | WO01/98486 | 12/2001 |
| WO | WO 02/06521 | 1/2002 |
| WO | WO 02/50096 | 6/2002 |
| WO | WO03/008574 | 1/2003 |
| WO | WO 2004/085674 | 10/2004 |
| WO | WO 2005/014863 | 2/2005 |

OTHER PUBLICATIONS

Lossin C. Brain and Development (2009) vol. 31, pp. 114-130.*
Abstracts of Decisions. Decision of a Delegate of the Commissioner of Patents corresponding to an Australian Patent Application No. 18465/01 issued Jan. 29, 2007.
Alekov et al., "A sodium channel mutation causing epilepsy in man exhibits subtle defects in fast inactivation and activation in vitro," Journal of Physiology, vol. 529, No. 3, pp. 533-539 (2000).
Andermann, "Multifactorial Inheritance of Generalized and Focal Epilepsy," Genetic Basis of the Epilepsies, pp. 355-374 (1982).
Annegers, "The Epidemiology of Epilepsy," The Treatment of Epilepsy: Principles and Practice, Chpt. 11, pp. 165-172 (1996).
Baulac et al., "A Second Locus for Familial Generalized Epilepsy with Febrile Seizures Plus Maps to Chromosome 2q21-q33," Am. J. Hum. Genet., vol. 65, pp. 1078-1085 (1999).
Beaumanoir, In: Epileptic Syndromes in Infancy, Childhood and Adolescence, $2^{nd}$ ed., Roger J BM et al., editor, London: John Libbey & Co. Ltd., pp. 113-136 (2002).
Bell and Lathrop, "Multiple loci for multiple sclerosis," Nature Genetics, vol. 13, pp. 377-378 (Aug. 1996).
Bendahhou et al., "Activation and Inactivation of the Voltage-Gated Sodium Channel: Role of Segment S5 Revealed by a Novel Hyperkalaemic Periodic Paralysis Mutation," J. Neurosci., vol. 19, pp. 4762-4771 (1999).
Berkovic et al., "Concepts of absence epilepsies: Discrete syndromes or biological continuum?" Neurology, vol. 37, No. 6, pp. 993-1000 (Jun. 1987).
Berkovic et al., "Familial Epilepsies in Israel: Clinical Syndromes and Modes of Inheritance," Neurology, vol. 54, Suppl. 3, A356, No. P05.063 (Apr. 2000).
Berkovic et al., "The epilepsies: specific syndromes or a neurobiological continuum?" Epileptic Seizures and Syndromes, Chpt. 5, pp. 25-37 (1994).

(Continued)

*Primary Examiner* — Stephen Kapushoc
(74) *Attorney, Agent, or Firm* — Jenkins, Wilson, Taylor & Hunt, P.A.

(57) ABSTRACT

A method for the diagnosis of SMEI in a patient comprising:
(1) detecting an alteration in the SCN1A gene, including in a regulatory region of the gene, in a patient sample;
(2) ascertaining whether the alteration is known to be SMEI associated or non-SMEI associated; and
(3) (a) establishing a diagnosis of a high probability of SMEI where the alteration is known to be SMEI associated; or
  (b) establishing a diagnosis of a low probability of SMEI where the alteration is non-SMEI associated; or
  (e) or, if not known to be either,
    (i) considering genetic data for parents and/or relatives;
    (ii) establishing whether the alteration has arisen de novo or is inherited; and
    (iii) establishing a diagnosis of a low probability of SMEI where the alteration is inherited but a diagnosis of a high probability of SMEI if the alteration is de novo.

5 Claims, 1 Drawing Sheet

OTHER PUBLICATIONS

Bertrand et al., "Properties of neuronal nicotinic acetylcholine receptor mutants from humans suffering from autosomal dominant nocturnal frontal lobe epilepsy," British J. of Pharmacology, vol. 124, pp. 1-10 (1998).

Bievert et al., "A Potassium Channel Mutation in Neonatal Human Epilepsy," Science, vol. 279, pp. 403-406 (Jan. 16, 1998).

Blume, W. T., "Childhood brain tumors presenting as chronic uncontrolled focal seizure disorders," Ann. Neurol., vol. 4, pp. 541-547 (1978). [found source to order from].

Bourgeois, "Chronic Management of Seizures in the Syndromes of Idiopathic Generalized Epilepsy," Epilepsia, 44 (Suppl. 2), pp. 27-32 (2003).

Breaker et al., "A DNA enzyme with Mgt+-dependent RNA phosphoesterase activity," Chemistry and Biology, vol. 2, No. 10, pp. 655-660 (1995).

Burnstine et al., "Multifocal Independent epileptiform discharges in children: Ictal correlates and surgical therapy," Neurology, vol. 41, pp. 1223-1228 (1991). [found source to order from].

Cannon, "Sodium Channel Gating: No Margin for Error," Neuron, vol. 34, pp. 853-858 (Jun. 13, 2002).

Cavazzuti et al., "Longitudinal Study of Epileptiform EEG Patterns in Normal Children," Epilepsia, vol. 21, pp. 43-55 (1980).

Charlier et al., "A pore mutation in a novel KQT-like potassium channel gene in an idiopathic epilepsy family," Nature Genetics, vol. 18, pp. 53-55 (Jan. 1998).

Chou et al., "The lack of association between febrile convulsions and polymorphisms in SCNIA," Epilepsy Research, vol. 54, pp. 53-57 (2003).

Claes et al., "De novo SCN1A mutations are a major cause of severe myoclonic epilepsy of infancy," Hum. Mutat., vol. 21, pp. 615-621 (2003).

Claes et al., "De Novo Mutations in the Sodium-Channel Gene SCN1A Cause Severe Myoclonic Epilepsy of Infancy," American Journal of Human Genetics, vol. 68, pp. 1327-1332 (2001).

Cole et al., "Human monoclonal antibodies," Molecular and Cellular Biochemistry, vol. 62, pp. 109-120 (1984).

Collins, "Positional cloning moves from perditional to traditional," Nature Genetics, vol. 9, pp. 347-349 (Apr. 1995).

Commission on Classification and Terminology of the International League Against Epilepsy, "Proposal for Revised Classification of Epilepsies and Epileptic Syndromes," Epilepsia, vol. 30, No. 4, pp. 389-399 (1989).

Communication pursuant to Rule 46(1) EPC corresponding to European Application No. 04718885.9-2402 PCT/AU2004000295 dated Jul. 14, 2006.

Cote et al., "Generation of human monoclonal antibodies reactive with cellular antigens," Proceedings of the National Academy of Science of the USA, vol. 80, pp. 2026-2030 (1983).

Database UniProt, "Sodium channel protein type I alpha subunit," XP002313393, retrieved from EBI accession No. UniProt: CIN1_Human, Database accession No. P35498. (Abstract), (2001).

DePalma, A., "Capturing Proteins Using Antibody Arrays," from Genomics and Proteomics; available online from author at www.adeplama.com, pp. 1-5, (2005).

Doose and Baier, "Genetic Aspects of Childhood Epilepsy," Cleveland Clinic Journal of Medicine, vol. 56, Suppl. Part 1, S101-S110 (1989).

Doose and Baier, "Genetic Factors in Epilepsies with Primarily Generalized Minor Seizures," Neuropediatrics, vol. 18, Suppl. I, pp. 1-64 (Feb. 1987).

Doose et al., "Severe idiopathic generalized epilepsy of infancy with generalized tonic-clonic seizures," Neuropediatrics, vol. 29, pp. 229-238 (1998). [found source to order from].

Dravet et al., In: Epileptic Syndromes in Infancy, Childhood and Adolescence, 3$^{rd}$ ed., Eastleigh: John Libbey & Co., Ltd. pp. 81-103 (2002).

Dworakowska and Dolowy, "Ion channels-related diseases," ACTA Biochimica Poloncia, vol. 47, No. 3, pp. 685-703 (2000).

Escayg et al., "Mutations of SCN1A, encoding a neuronal sodium channel, in two families with GEFS+2," Nature Genetics, vol. 24, pp. 343-345 (Apr. 2000).

Escayg et al., "A Novel SCN1A Mutatin Associated with Generalized Epilepsy with Febrile Seizures Plus- and Prevelance of Variants in Patients with Epilepsy," Am. J. of Hum. Genet., vol. 68, pp. 866-873 (2001).

European Patent Office Search Report corresponding to European Patent Application No. 07075566.5-2401 dated Oct. 4, 2007.

Examiner's First Report for Australian Patent Application No. 2004200978 dated May 6, 2004.

Finkelstein et al., "Use of denaturing gradient gel electrophoresis for detection of mutation and prospective diagnosis in late onset ornithine transcarbamylase deficiency," Genomics, vol. 7, pp. 167-172 (1990).

Fong et al., "Childhood Absence Epilepsy with Tonic-Clonic Seizures and Electroencephalogram 3-4-Hz Spike and Multispike—Slow Wave Complexes: Linkage to Chromosome 8q24," Am. J. Hum. Genet., vol. 63, pp. 1117-1129 (1998).

Fujiwara et al., "Mutations of sodium channel a subunit type 1 (SCNIA) in intractable childhood epilepsies with frequent generalized tonic-clonic seizures," Brain, vol. 126, pp. 531-546 (2003).

Fujiwara et al., "Long-Term Course of Childhood Epilepsy with Intractable Grand Mal Seizures," Jpn. J. Psychiatry Neurol., vol. 46, pp. 297-302 (1992).

Fukuma G., "Mutations of neuronal voltage-gated Na+ channel alpha 1 subunit gene SCN1A in core severe myoclonic epilepsy in infancy (SMEI) and in borderline SMEI (SMEB)," Epilepsia, vol. 45, No. 2, pp. 140-148 (Feb. 2004).

Gardiner, "Impact of our understanding of the genetic aetiology of epilepsy," J. Neurol., vol. 247, pp. 327-334 (2000).

Gene Card for SCNA1 available via uri: <genecards.org/cgi-bin/carddisp.pl?gene=SCN1A>, (2007).

GeneCards output for protein-coding SCN1A, available online from www.genecards.org, pp. 1-20, (2006).

GenBank Locus NM_006920, "Homo sapiens sodium channel, voltage-gated, type I, alpha (SCN1A), mRNA," pp. 1-11 (Nov. 13, 2006).

GenBank Locus AF225985, "Homo sapiens voltage-gated sodium channel alpha subunit SCN1A (SCN1A) mRNA, complete cds," pp. 1-4 (Feb. 1, 2001).

Genbank accession No. AB093548, (2002).

Genbank accession No. M22253 (1995).

Genbank accession No. NN_012647, (2010).

Gennaro et al., "Familial severe myoclonic epilepsy of infancy: truncation of Na$_v$1.1 and genetic heterogeneity," Epileptic Disord., vol. 5, pp. 21-25 (2003).

Geysen H.M. et al., "Cognitive features of continuous antigenic determinants," Journal of Molecular Recognition, vol. 1, pp. 32-41 (1988).

Goldman et al., "In vitro and in vivo gene delivery mediated by a synthetic polycationic amino polymer," Nature Biotechnology, vol. 15, pp. 462-466 (1997).

Goldsby et al., "Immunology," Fifth Edition, section "Cross-Reactivity," p. 141 (2003).

Gonzalez et al., "Cell-based assays and instrumentation for screening ion-channel targets," Drug Discovery Today, vol. 4, No. 9, pp. 431-439 (1999).

Greenberg et al., "Evidence for multiple gene loci in the expression of the common generalized epilepsies," Neurology, vol. 42, Suppl. 5, pp. 56-62 (Apr. 1992).

Greenberg et al., "Juvenile Myoclonic Epilepsy (JME) May be Linked to the BF and HLA Loci on Human Chromosome 6," Am. J. of Medical Genetics, vol. 31, pp. 185-192 (1988).

Greenberg et al., "Segregation Analysis of Juvenile Myoclonic Epilepsy," Genetic Epidemiology, vol. 5, pp. 81-94 (1988).

Guerrini et al., Lamotrigine and seizure aggravation in severe myoclonic epilepsy, Epilepsia, vol. 39s, pp. 508-512 (1998).

Hamill et al., "Improved patch-clamp techniques for high-resolution current recording from cells and cell-free membrane patches," Pflügers Archiv European Journal of Physiology, vol. 391, pp. 85-100 (1981).

Harkin et al., "The Spectrum of SCN1A-Related Infantile Epileptic Encephalopathies," Brain, vol. 130, pp. 843-852 (2007).

Haseloff et al., "Simple RNA enzymes with new and highly specific endoribonuclease activities," Nature, vol. 334, No. 18, pp. 585-591 (1988).

Hauser et al., "Incidence of Epilespy and Unprovoked Seizures in Rochester, Minnesota: 1935-1984," Epilepsia, vol. 34, No. 3, pp. 453-468 (1993).
Heller et al., "Discovery and analysis of inflammatory disease-related genes using cDNA microarrays," Proceedings of the National Academy of Sciences of the USA, vol. 94, pp. 2150-2155 (1997).
Hille, "Ionic Channels of Exciteable Membranes," $2^{nd}$ Edition, pp. 423 and 343-444 (1992).
Hirschhorn et al., "A comprehensive review of genetic association studies," Genetics in Medicine, vol. 4, No. 2, pp. 45-61 (2002).
Huse et al., "Generation of a large combinatorial library of the immunoglobylin repertoire in phage lambda," Science, vol. 246, pp. 1275-1281 (1989).
International Search Report for International Application No. PCT/AU2004/000295 dated May 14, 2004.
Interview Summary corresponding to U.S. Appl. No. 11/262,647 dated Dec. 5, 2008.
Interview Summary corresponding to U.S. Appl. No. 10/806,899 dated Nov. 23, 2009.
Interview Summary corresponding to U.S. Appl. No. 10/806,899 dated Oct. 8, 2009.
Interview Summary corresponding to U.S. Appl. No. 10/806,899 dated Nov. 1, 2007.
Italian League Against Epilepsy Genetic Collaborative Group, Epilepsia, vol. 34, pp. 819-826 (1993).
Janz et al., "Do idiopathic generalized epilepsies share a common susceptibility gene?" Neurology, vol. 42, Suppl 5, pp. 48-55 (Apr. 1992).
Kanai et al., "Effect of localization of missense mutations in SCN1A on epilepsy phenotype severity," Neurology, vol. 63, pp. 329-334 (2004).
Kimura K., "A missense mutation in SCN1A in brothers with severe myoclonic epilepsy in infancy (SMEI) inherited from a father with febrile seizures," Brain Dev., vol. 27, No. 6, pp. 424-430 (Sep. 2005).
Kinzler et al., "Identification of a gene located at chromosome 5q21 that is mutated in colorectal cancers," Science, vol. 251, pp. 1366-1370 (1991).
Kohler et al., "Continuous cultures of fused cells secreting antibody of predefined specificity," Nature, vol. 256, pp. 495-497 (1975).
Kozbor et al., "Specific immunoglobulin production and enhanced tumorigenicity following ascites growth of human hybridomas," Journal of Immunological Methods, vol. 81, pp. 31-42 (1985).
Kuhn et al., "Movement of voltage sensor S4 in domain 4 is tightly coupled to sodium channel fast inactivation and gating charge immobilization," J. Gen. Physiol., vol. 114, pp. 167-183 (1999).
Lason W., "Neurochemical and pharmacological aspects of cocaine-induced seizures," Polish Journal of Pharmacology, vol. 53, pp. 57-60 (2001).
Lerche et al., "Ion Channels and Epilepsy," Am. J. of Med. Genetics, vol. 106, pp. 146-159 (2001).
Lernmark and Ott, "Sometimes it's hot, sometimes it's not," Nature Genetics, vol. 19, pp. 213-214 (Jul. 1998).
Lo et al., "High Level Expression and Secretion of Fc-X Fusion Proteins in Mammalian Cells," Protein Engineering, vol. 11, pp. 495-500 (1998).
Lopes-Cendes et al., "A New Locus for Generalized Epilepsy with Febrile Seizures Plus Maps to Chromosome 2," Am. J. Hum. Genet., vol. 66, pp. 698-701 (2000).
Lucentini, J., "Gene Asscoiation Studies Typically Wrong," The Scientist, p. 20 (Dec. 20, 2004).
Madia et al., "No evidence of GABRG2 mutations in severe myoclonic epilepsy of infancy," Epilepsy Research, vol. 53, pp. 196-200 (2003).
Malacarne et al., "Lack of SCN1A Mutations in Familial Febrile Seizures," Epelepsia, vol. 43, No. 5, pp. 559-562 (2002).
Markand, O. N., "Slow spike-wave activity in EEG and associated clinical features: often called 'Lennox' or 'Lennox-Gastaut' syndrome," Neurology, vol. 27, pp. 746-757 (1997). [found source to order from].
Maxam et al., "A new method for sequencing DNA," Proceedings of the National Academy of Sciences of the USA, vol. 74, No. 2, pp. 560-564 (1977).

Mazumder et al., "Translations control by the 3'•UTR: the ends specify the means," Trends in Biochemical Sciences, vol. 28, pp. 91-98 (2004).
Modrich, Paul, "Mechanisms and biological effects of mismatch repair," Annual Review of Genetics, vol. 25, pp. 229-253 (1991).
Moran et al., "Skeletal Muscle Sodium Channel is Affected by an Epileptogenic β1 Subunit Mutation," Biochem. Biophys. Res. Comm., vol. 282, pp. 55-59 (2001).
Moulard et al., "Identification of a New Locus for Generalized Epilepsy with Febrile Seizures Plus (GEFS+) on Chromosome 2q24-q33," Am. J. Hum. Genet., vol. 65, pp. 1396-1400 (1999).
Mulley et al., "SCN1A Mutations and Epilepsy," Human Mutation, vol. 25, pp. 535-542 (2005).
Mulley et al., "Channelopathies as a Genetic Cause of Epilepsy," Current Opinion in Neurology, vol. 16, pp. 171-176 (2003).
Nabbout et al., "Spectrum of SCN1A Mutations in Severe Myoclonic Epilepsy of Infancy," Neurology, vol. 60, pp. 1961-1967 (Jun. 2003).
Noriega-Sanchez et al., "Clinical and electroencephalographic correlation of independent multifocal spike discharges," Neurology, vol. 26, pp. 667-672 (1976). [found source to order from].
Notification Concerning Transmittal of International Preliminary Report on Patentability for International Application No. PCT/AU2006/000841 dated Jan. 3, 2008.
Notice of Allowance corresponding to U.S. Appl. No. 10/451,126 (Patent No. 7,078,515) dated Aug. 30, 2005.
Notice of Allowance corresponding to U.S. Appl. No. 11/263,326 (Patent No. 7,282,336) dated Jun. 18, 2007.
Notice of Allowance corresponding to U.S. Appl. No. 11/262,647 dated Dec. 18, 2009.
Notice of Allowance corresponding to U.S. Appl. No. 10/806,899 dated Jan. 4, 2010.
Official Communication of U.S. Patent and Trademark Office corresponding to U.S. Appl. No. 10/482,834 dated Aug. 7, 2009.
Official Communication of U.S. Patent and Trademark Office corresponding to U.S. Appl. No. 10/482,834 dated Dec. 30, 2008.
Official Communication of U.S. Patent and Trademark Office corresponding to U.S. Appl. No. 10/482,834 dated Apr. 4, 2008.
Official Communication of U.S. Patent and Trademark Office corresponding to U.S. Appl. No. 10/482,834 dated Aug. 2, 2007.
Official Communication of U.S. Patent and Trademark Office corresponding to U.S. Appl. No. 10/806,899 dated Oct. 28, 2009.
Official Communication of U.S. Patent and Trademark Office corresponding to U.S. Appl. No. 10/806,899 dated May 13, 2009.
Official Communication of U.S. Patent and Trademark Office corresponding to U.S. Appl. No. 10/806,899 dated Aug. 19, 2008.
Official Communication of U.S. Patent and Trademark Office corresponding to U.S. Appl. No. 10/806,899 dated Jun. 26, 2007.
Official Communication of U.S. Patent and Trademark Office corresponding to U.S. Appl. No. 10/806,899 dated Nov. 29, 2006.
Official Communication of U.S. Patent and Trademark Office corresponding to U.S. Appl. No. 11/263,326 (Patent No. 7,282,336) dated Oct. 6, 2006.
Official Communication of U.S. Patent and Trademark Office corresponding to U.S. Appl. No. 11/262,647 dated Apr. 22, 2009.
Official Communication of U.S. Patent and Trademark Office corresponding to U.S. Appl. No. 11/262,647 dated Dec. 5, 2008.
Official Communication of U.S. Patent and Trademark Office corresponding to U.S. Appl. No. 11/262,647 dated Feb. 15, 2008.
Official Communication of U.S. Patent and Trademark Office corresponding to U.S. Appl. No. 10/451,126 (Patent No. 7,078,515) dated Jan. 24, 2005.
Ohmori et al., "Is phenotype difference in severe myoclonic epilepsy in infancy related to SCN1A mutations?," Brain Dev., vol. 25, pp. 488-493 (2003). [found source to order from].
Ohmori et al., "Significant correlation of the SCN1A mutations and severe myoclonic epilepsy in infancy," Biochemical and Biophysical Research Communications, vol. 295, pp. 17-23 (2002).
Ohtahara et al., "Lennox-Gastaut syndrome: a new vista," Psychiatry Clin. Neurosci., vol. 49, pp. S179-S183 (1995). [on server].
Ohtsuka et al., "Long-term prognosis of the Lennox-Gastaut syndrome," Jpn. J. Psychiatry Neurol., vol. 44, pp. 257-264 (1990). [on server].

Ohtsuka et al., "Refractory Childhood Epilepsy and Factors Related to Refractoriness," Epilepsia, vol. 41, Suppl. 9, pp. 14-17 (2000). [on server].

Okubo et al., "Epileptiform EEG Discharges in Healthy Children: Prevalence, Emotional and Behavioral Correlates, and Genetic Influences," Epilepsia, vol. 35, No. 4, pp. 832-841 (1994).

Orita et al., "Detection of polymorphisms of human DNA by gel electrophoresis as single-strand confirmation polymorphisms," Proceedings of the National Academy of Sciences of the USA, vol. 86, pp. 2766-2770 (1989).

Orlandi et al., "Cloning immnoglobuin variable domains for expression by the polymerase chain reaction," Proceedings of the National Academy of Sciences of the USA, vol. 85, pp. 3833-3837 (1989).

Panayiotopoulos and Obeid, "Juvenile Myoclonic Epilepsy: An Autosomal Recessive Disease," Ann Neurol, vol. 25, pp. 440-443 (1989).

Peiffer et al., "A Locus for Febrile Seizures (FEB3) Maps to Chromosome 2q23-24," Annals of Neurology, vol. 46, No. 4, pp. 671-678 (Oct. 1999).

Phillips et al., "Autosomal Dominant Nocturnal Frontal-Lobe Epilepsy: Genetic Heterogeneity and Evidence for a Second Locus at 15q24," Am. J. Hum. Genet., vol. 63, pp. 1108-1116 (1998).

Phillips et al., "CHRNB2 is the Second Acetylcholine Receptor Subunit Associated with Autosomal Dominant Nocturnal Frontal Lobe Epilepsy," Am. J. Hum. Genet., vol. 68, pp. 225-231 (2001).

Phillips et al., "Localization of a gene for autosomal dominant nocturnal frontal lobe epilepsy to chromosome 20q13.2," Nature Genetics, vol. 10, pp. 117-118 (May 1995).

Plummer et al., "Exon Organization, Coding Sequence, Physical Mapping, and Polymorphic Intragenic Markers for the Human Neuronal Sodium Channel Gene SCN8A," Genomics, vol. 54, pp. 287-296 (1998).

Plummer et al., "Evolution and Diversity of Mammalian Sodium Channel Genes," Genomics, vol. 57, pp. 323-331 (1999).

Reutens and Berkovic, "Idiopathic generalized epilepsy of adolescence: Are the syndromes clinically distinct?" Neurology, vol. 45, pp. 1469-1476 (Aug. 1995).

Rickert et al., "B lymphocyte-specific, Cre-mediated mutagenesis in mice," Nucleic Acids Research, vol. 25, No. 6, pp. 1317-1318 (1997).

Risch and Botstein, "A manic depressive history," Nature Genetics, vol. 12, pp. 351-353 (Apr. 1996).

Sanger et al., "DNA sequencing with chain-terminating inhibitors," Proceedings of the National Academy of Sciences of the USA, vol. 74, No. 12, pp. 5463-5467 (1977).

Scharf et al., "Heat stress promoters and transcription factors," Results and Problems in Cell Differentiation, vol. 20, pp. 125-162 (1994).

Scheffer and Berkovic, "Generalized epilepsy with febrile seizures plus A genetic disorder with heterogeneous clinical phenotypes," Brain, vol. 120, pp. 479-490 (1997).

Scheffer et al., "The Genetics of Human Epilepsy," TRENDS in Pharmacological Science, vol. 24, No. 8, pp. 428-433 (Aug. 2003).

Scheffer et al., "Locus for Febrile Seizures," Annals of Neurology, vol. 47, No. 6, pp. 840-841 (Jun. 2000).

Schena et al., "Parallel human genome analysis: Microarray-based expression monitoring of 1000 genes," Proceedings of the National Academy of Sciences of the USA, vol. 93, pp. 10614-10619 (1996).

Schwenk et al., "A cre-transgenic mouse strain for the ubiquitous deletion of loxP-flanked gene segments including deletion in germ cells," Nucleic Acids Research, vol. 23, No. 24, pp. 5080-5081 (1995).

Sheffield et al., "Attachment of a 40-base-pair G+C-rich sequence (GC-clamp) to 175 genomic DNA fragments by the polymerase chain reaction results," Proceedings of the National Academy of Science of the USA, vol. 86, pp. 232-236 (1989).

Singh et al., "Generalized Epilepsy with Febrile Seizures Plus: A Common Childhood-Onset Genetic Epilepsy Syndrome," Ann. Neurol., vol. 45, pp. 75-81 (1999).

Singh et al., "A novel potassium channel gene, KCNQ2, is mutated in an inherited epilepsy of newborns," Nature Genetics, vol. 18, pp. 25-29 (Jan. 1998).

Singh et al., "Severe Myoclonic Epilepsy of Infancy: Extended Spectrum of GEFS?" Epilepsia, vol. 42, No. 7, pp. 837-844 (2001).

Spampanato et al., "Generalized Epilepsy with Febrile Seizures Plus Type 2 Mutation W1204R Alters voltage-Dependent Gating of $Na_v1.1$ Sodium Channels," Neuroscience, vol. 116, pp. 37-48 (2003).

Stafstrom et al., "Epilepsy Genes: The link between molecular dysfunction and pathophysiology", Mental Retardation and Developmental Disabilities Research Reviews, vol. 6, pp. 281-292 (2000).

Steinlein et al., "A missense mutation in the neuronal nicotinic acetylcholine receptor $\alpha 4$ subunit is associated with autosomal dominant nocturnal frontal lobe epilepsy," Nature Genetics, vol. 11, pp. 201-203 (Oct. 1995).

Sugawara et al., "Frequent mutations of SCN1A in severe myoclonic epilepsy in infancy," Neurology, vol. 58, pp. 1122-1124 (2002).

Sugawara, T., "Nav1.1 channels with mutations of severe myoclonic epilepsy in infancy display attenuated currents," Epilepsy Res., vol. 54, Nos. 2-3, pp. 201-207 (May 2003).

Supplementary European Search Report corresponding to Australian Patent No. AU0200910 dated Feb. 17, 2005.

Supplementary Partial European Search Report for Application No. 01271383.0-2406 dated Mar. 12, 2004.

Taylor et al., "Enzymatic methods for mutation scanning," Genetic Analysis: Biomolecular Engineering, vol. 14, pp. 181-186 (1999).

Thisted, "What is a P-value?" available online from www.stat.uchicago.edu, pp. 1-6 (May 25, 1998).

Todd, "Interpretation of results from genetic studies of multifactorial disease," Molecular Medicine, vol. 354, pp. 15-16 (Jul. 1999).

Veggiotti et al., "Generalized Epilepsy with Febrile Seizures plus and Severe Myoclonic Epilepsy in Infancy: a case report of two Italian families," Epileptic Discord, vol. 3, pp. 29-32 (2001).

Wallace et al., "Sodium Channel E L-Subunit Mutations in Severe Myoclonic Epilepsy of Infancy and Infantile Spasms," Neurology, vol. 61, pp. 765-769 (Sep. 2003).

Wallace et al., "Febrile seizures and generalized epilepsy associated with a mutation in the $Na^+$-channel $\beta 1$ subunit gene SCN1B," Nature Genetics, vol. 19, pp. 366-370 (Aug. 1998).

Wallace et al., "Mutant $GABA_A$ receptor $\gamma 2$-subunit in childhood absence epilepsy and febrile seizures," Nature Genetics, vol. 28, pp. 49-52 (May 2001).

Wallace et al., "Neuronal Sodium-Channel $\alpha 1$-Subunit Mutations in Generalized Epilepsy with Febrile Seizures Plus," The American Journal of Human Genetics, vol. 68, Issue 4, 859-865 (Apr. 1, 2001).

Wallace R., "A Plethora of SCN1A Mutations: What Can They Tell Us?" Epilepsy Curro., vol. 5, No. 1, pp. 17-20 (Jan. 2005).

Wartell et al., "Detecting base pair substitutions in DNA fragments by temperature-gradient gel electrophoresis," Nucleic Acids Research, vol. 18, No. 9, pp. 2699-2705 (1990).

Winter et al., "Man-made antibodies," Nature, vol. 349, pp. 293-299 (1991).

Wyman et al., "A highly polymorphic locus in human DNA," Proceedings of the National Academy of Sciences of the USA, vol. 77, No. 11, pp. 6754-6758 (1980).

Yamatogi et al., "Severe Epilepsy with Multiple Independent Spike Foci," J. Clin. Neurophysiol., vol. 20, pp. 442-448 (2003). [found source to order from].

Zara et al., "Mapping of genes predisposing to idiopathic generalized epilepsy," Human Molecular Genetics, vol. 4, No. 7, pp. 1201-1207 (1995).

Zara et al., "Mapping of Locus for a Familial Autosomal Recessive Idiopathic Myoclonic Epilepsy of Infancy to Chromosome 16p13," Am. J. Hum. Genet., vol. 66, pp. 1552-1557 (2000).

Notice of Allowance correponding to U.S. Appl. No. 10/567,424 dated Oct. 26, 2011.

Office Action corresponding to U.S. Appl. No. 11/922,377 dated Nov. 30, 2011.

* cited by examiner

Sample
↓
Screen to Identify
SCN1A Alterations
↓
SCN1A Alteration
↙ ↓ ↘

One or more assays (identifying the existence of an SCN1A alteration)

One or more assays (determine the nature of the SCN1A alteration)

Known alteration SMEI-causing — High Probability of SMEI

Unknown alteration ↓

Known alteration Non-SMEI causing — Low Probability of SMEI

Screen Parents/Relatives For Alteration
-ve ↙   +ve ↘

*De Novo*
↓
Truncation
Very High Probability of SMEI (80-100%)

Inherited
Low Probability of SMEI

DIAGNOSTIC METHOD FOR EPILEPSY

RELATED APPLICATIONS

This application is a continuation of U.S. patent application Ser. No. 10/806,899, filed Mar. 23, 2004, now U.S. Pat. No. 7,723,027, which claims the benefit of Australian Patent Application No. 2003901425, filed Mar. 27, 2003, the disclosures of which are incorporated herein by reference in their entirety.

TECHNICAL FIELD

The present invention relates to the diagnosis and treatment of epilepsy, particularly severe myoclonic epilepsy of infancy (SMEI).

BACKGROUND ART

Epilepsies constitute a diverse collection of brain disorders that affect about 3% of the population at some time in their lives (Annegers, 1996). An epileptic seizure can be defined as an episodic change in behaviour caused by the disordered firing of populations of neurons in the central nervous system. This results in varying degrees of involuntary muscle contraction and often a loss of consciousness. Epilepsy syndromes have been classified into more than 40 distinct types based upon characteristic symptoms, types of seizure, cause, age of onset and EEG patterns (Commission on Classification and Terminology of the International League Against Epilepsy, 1989). However the single feature that is common to all syndromes is the persistent increase in neuronal excitability that is both occasionally and unpredictably expressed as a seizure.

A genetic contribution to the aetiology of epilepsy has been estimated to be present in approximately 40% of affected individuals (Gardiner, 2000). As epileptic seizures may be the end-point of a number of molecular aberrations that ultimately disturb neuronal synchrony, the genetic basis for epilepsy is likely to be heterogeneous. There are over 200 Mendelian diseases which include epilepsy as part of the phenotype. In these diseases, seizures are symptomatic of underlying neurological involvement such as disturbances in brain structure or function. In contrast, there are also a number of "pure" epilepsy syndromes in which epilepsy is the sole manifestation in the affected individuals. These are termed idiopathic and account for over 60% of all epilepsy cases.

Idiopathic epilepsies have been further divided into partial and generalized sub-types. Partial (focal or local) epileptic fits arise from localized cortical discharges, so that only certain groups of muscles are involved and consciousness may be retained (Sutton, 1990). However, in generalized epilepsy, EEG discharge shows no focus such that all subcortical regions of the brain are involved. Although the observation that generalized epilepsies are frequently inherited is understandable, the mechanism by which genetic defects, presumably expressed constitutively in the brain, give rise to partial seizures is less clear.

The idiopathic generalized epilepsies (IGE) are the most common group of inherited human epilepsy and do not have simple inheritance. Two broad groups of IGE are now known—the classical idiopathic generalized epilepsies (Commission on Classification and Terminology of the International League Against Epilepsy, 1989) and the newly recognized genetic syndrome of generalized epilepsy with febrile seizures plus (GEFS$^+$) (Scheffer and Berkovic, 1997; Singh et al., 1999).

The classical IGEs are divided into a number of clinically recognizable but overlapping sub-syndromes including childhood absence epilepsy, juvenile absence epilepsy, juvenile myoclonic epilepsy etc (Commission on Classification and Terminology of the International League Against Epilepsy, 1989; Roger et al., 1992). The sub-syndromes are identified by age of onset and the pattern of seizure types (absence, myoclonus and tonic-clonic). Some patients, particularly those with tonic-clonic seizures alone do not fit a specifically recognized sub-syndrome. Arguments for regarding these as separate syndromes, yet recognizing that they are part of a neurobiological continuum, have been presented previously (Berkovic et al., 1987; 1994; Reutens and Berkovic, 1995).

GEFS$^+$ was originally recognized through large multi-generation families and comprises a variety of sub-syndromes. Febrile seizures plus (FS$^+$) is a sub-syndrome where children have febrile seizures occurring outside the age range of 3 months to 6 years, or have associated febrile tonic-clonic seizures. Many family members have a phenotype indistinguishable from the classical febrile convulsion syndrome and some have FS$^+$ with additional absence, myoclonic, atonic, or complex partial seizures. The severe end of the GEFS$^+$ spectrum includes myoclonic-astatic epilepsy.

In GEFS$^+$ families, linkage analysis on rare multi-generation large families with clinical evidence of a major autosomal dominant gene have demonstrated loci on chromosomes 19q and 2q. Both the 19q and 2q GEFS$^+$ loci have been confirmed in independently ascertained large families, and genetic defects have been identified. Families linked to 19q are known and a mutation in the gene for the $\beta1$ subunit of the neuronal sodium channel (SCN1B) has been identified (Wallace et al., 1998). This mutation results in the loss of a critical disulphide bridge of this regulatory subunit and causes a loss of function in vitro. Families linked to 2q are also known and mutations in the pore-forming $\alpha$ subunit of the neuronal sodium channel (SCN1A) have been identified (PCT/AU01/01648; Escayg et al., 2000).

Severe myoclonic epilepsy of infancy (SMEI) is classed as an epileptic syndrome that manifests as both generalised and focal (partial) seizures (Commission on Classification and Terminology of the International League Against Epilepsy, 1989). SMEI begins with prolonged febrile and afebrile hemiclonic and generalised seizures in the first year of life. Between one and four years, other seizure types evolve including myoclonic, absence and atonic seizures. Neurological development is normal in infancy with progressive slowing after two years. A family history of epilepsy and/or febrile seizures is often found in SMEI patients and recent work has shown that family members have epilepsy phenotypes consistent with the GEFS+ spectrum (Singh et al., 2001; Veggiotti, 2001). From a clinical perspective, as GEFS+ and SMEI involve fever-related seizures, it was thought that sodium channel genes may be the target for mutations in SMEI affected individuals. This fact was later confirmed when mutations in the SCN1A gene in SMEI patients were identified (Claes et al., 2001; Ohmori et al., 2002). Of interest is that each of these mutations were de novo, a fact difficult to reconcile based on the clinical experience that a significant number of SMEI cases have a family history of GEFS+.

BRIEF DESCRIPTION OF THE DRAWINGS

FIG. 1 is a flowchart which illustrates a strategy that can be used to determine the likelihood that an alteration in the SCN1A gene is responsible for SMEI.

The development of a molecular diagnostic test to aid in the early diagnosis of SMEI is important. Such a test would direct the correct treatment strategy for patients likely to be affected with SMEI and would predict a risk for seizure aggravation as a result of factors such as fever induced by vaccination or other causes. Clinical studies to determine the molecular basis of SMEI have been variable in their results and have been inconclusive as to a single molecular basis for SMEI, particularly as alterations in the SCN1A gene are involved in other epilepsy subtypes. The inventors have recognised the need for such a predictive diagnostic test for SMEI and have therefore established a method that overcomes the limitations identified in previous clinical studies and determines the likelihood that an epilepsy patient has SMEI based on a molecular analysis of the SCN1A gene.

DISCLOSURE OF THE INVENTION

In a first aspect of the present invention there is provided a method for the diagnosis of SMEI in a patient comprising:
(1) detecting an alteration in the SCN1A gene, including in a regulatory region of the gene, in a patient sample;
(2) ascertaining whether the alteration is known to be SMEI associated or non-SMEI associated; and
(3) (a) establishing a diagnosis of a high probability of SMEI where the alteration is known to be SMEI associated; or
  (b) establishing a diagnosis of a low probability of SMEI where the alteration is non-SMEI associated; or
  (c) or, if not known to be either,
    (i) considering genetic data for parents and/or relatives;
    (ii) establishing whether the alteration has arisen de novo or is inherited; and
    (iii) establishing a diagnosis of a low probability of SMEI where the alteration is inherited but a diagnosis of a high probability of SMEI if the alteration is de novo.

In an embodiment the invention further comprises establishing whether the alteration would result in a major disruption to the protein and, if de novo, establishing a diagnosis of a very high probability of SMEI.

This information is important for initiating the correct treatment regimen for a patient. Current antiepileptic drug (AED) treatments may aggravate seizures in some patients with epilepsy. This may take the form of increased seizure frequency, increased seizure severity, or the appearance of a new seizure type. With respect to SMEI, it is known that carbamazepine, gabapentin, lamotrigine and vigabatrin may aggravate seizures (Bourgeois, 2003) whereas valproate has shown to be of benefit to SMEI patients (Scheffer and Berkovic, 2003). The diagnostic method of the present invention therefore will provide important information towards directing the appropriate primary AED selection in patients suspected of having SMEI.

The nature of the alterations in the SCN1A gene may encompass all forms of gene mutations including deletions, insertions, rearrangements and point mutations in the coding and non-coding regions such as the promoter, introns or untranslated regions. Deletions may be of the entire gene or only a portion of the gene whereas point mutations may result in stop codons, frameshifts or amino acid substitutions. Point mutations occurring in the regulatory regions of SCN1A, such as in the promoter, may lead to loss or a decrease of expression of the mRNA or may abolish proper mRNA processing leading to a decrease in mRNA stability or translation efficiency.

The identification of SCN1A alterations in a patient that lead to more severe changes to the SCN1A protein (such as frameshift mutations and nonsense mutations leading to a truncated protein) increases the likelihood that the patient has SMEI. This likelihood is increased even further if it can be shown that the alteration is a de novo change rather than one that is inherited from the patients parents or relatives, or that the alteration in the SCN1A gene is one that has previously been associated with SMEI. The flow chart in FIG. 1 illustrates one aspect of the present invention.

In an embodiment there is provided a method for the diagnosis of SMEI in a patient comprising performing one or more assays to test for the existence of an SCN1A alteration and to identify the nature of the alteration.

In a further embodiment there is provided a method for the diagnosis of SMEI in a patient comprising the steps of:
(1) performing one or more assays to test for the existence of an alteration in the SCN1A gene of the patient; and, if the results indicate the existence of an alteration in the SCN1A gene,
(2) performing one or more assays to identify the nature of the SCN1A alteration.

There exists a number of assay systems that can be used to test for the existence of an SCN1A alteration and the invention is not limited by the examples that are provided below.

In one embodiment an assay system employed may be the analysis of SCN1A DNA from a patient sample in comparison to wild-type SCN1A DNA. Genomic DNA may be used for the diagnostic analysis and may be obtained from a number of sources including, but not limited to, body cells, such as those present in the blood or cheek, tissue biopsy, surgical specimen, or autopsy material. The DNA may be isolated and used directly for the diagnostic assays or may be amplified by the polymerase chain reaction (PCR) prior to analysis. Similarly, RNA or cDNA may also be used, with or without PCR amplification. In addition, prenatal diagnosis can be accomplished by testing fetal cells, placental cells or amniotic fluid.

In a specific embodiment, a DNA hybridisation assay may be employed. These may consist of probe-based assays specific for the SCN1A gene. One such assay may look at a series of Southern blots of DNA that has been digested with one or more restriction enzymes. Each blot may contain a series of normal individuals and a series of patient samples. Samples displaying hybridisation fragments that differ in length from normal DNA when probed with sequences near or including the SCN1A gene (SCN1A gene probe) indicate a possible SCN1A alteration. If restriction enzymes that produce very large restriction fragments are used then pulsed field gel electropheresis (PFGE) may be employed.

SCN1A exon specific hybridisation assays may also be employed. This type of probe-based assay will utilize at least one probe which specifically and selectively hybridises to an exon of the SCN1A gene in its wild-type form. Thus, the lack of formation of a duplex nucleic acid hybrid containing the nucleic acid probe is indicative of the presence of an alteration in the SCN1A gene. Because of the high specificity of probe-based tests, any negative result is highly indicative of the presence of an SCN1A alteration however further investigational assays should be employed to identify the nature of the alteration to determine the likelihood it is an SMEI-associated alteration.

The SCN1A exon specific assay approach could also be adapted to identify previously determined SCN1A alterations responsible for SMEI. In this aspect, a probe which specifically and selectively hybridises with the SCN1A gene in its altered form is used (allele specific probe). In this case the formation of a duplex nucleic acid hybrid containing the nucleic acid probe is indicative of the presence of the alteration in the SCN1A gene. In each variation of the exon specific assay approach, it is important to take into account known polymorphisms in the SCN1A gene that are not associated with SMEI. A secondary assay such as DNA sequencing should subsequently be employed to ensure that any suspected alterations are not known polymorphisms.

The SCN1A exon specific probes used for each of the abovementioned assays may be derived from: (1) PCR amplification of each exon of the SCN1A gene using intron specific primers flanking each exon; (2) cDNA probes specific for each exon; or (3) a series of oligonucleotides that collectively represent an SCN1A exon.

In a further embodiment, an assay to analyse heteroduplex formation may be employed. By mixing denatured wild-type SCN1A DNA with a DNA sample from a patient, any sequence variations in the SCN1A sequence between the two samples will lead to the formation of a mixed population of heteroduplexes and homoduplexes during reannealing of the DNA. Analysis of this mixed population can be achieved through the use of such techniques as high performance liquid chromatography (HPLC) which are performed under partially denaturing temperatures. In this manner, heteroduplexes will elute from the HPLC column earlier than the homoduplexes because of their reduced melting temperature.

In a further embodiment, patient samples may be subject to electrophoretic-based assays. For example electrophoretic assays that determine SCN1A fragment length differences may be employed. Fragments of each patient's genomic DNA are amplified with SCN1A gene intron specific primers. The amplified regions of the SCN1A gene therefore include the exon of interest, the splice site junction at the exon/intron boundaries, and a short portion of intron at either end of the amplification product. The amplification products may be run on an electrophoresis size-separation gel and the lengths of the amplified fragments are compared to known and expected standard lengths from the wild-type gene to determine if an insertion or deletion mutation is found in the patient sample. This procedure can advantageously be used in a "multiplexed" format, in which primers for a plurality of exons (generally from 2 to 8) are co-amplified, and evaluated simultaneously on a single electrophoretic gel. This is made possible by careful selection of the primers for each exon. The amplified fragments spanning each exon are designed to be of different sizes and therefore distinguishable on an electrophoresis/size separation gel. The use of this technique has the advantage of detecting both normal and mutant alleles in heterozygous individuals. Furthermore, through the use of multiplexing it can be very cost effective.

In a further approach, diagnostic electrophoretic assays for the detection of previously identified SCN1A alterations responsible for SMEI may utilise PCR primers which bind specifically to altered exons of the SCN1A gene. In this case, product will only be observed in the electrophoresis gel if hybridization of the primer occurred. Thus, the appearance of amplification product is an indicator of the presence of the alteration, while the length of the amplification product may indicate the presence of additional alterations.

Additional electrophoretic assays may be employed. These may include the single-stranded conformational polymorphism (SSCP) procedure (Orita et al., 1989). As mentioned above, fragments of each patient's genomic DNA are PCR amplified with SCN1A gene intron specific primers such that individual exons of the SCN1A gene are amplified and may be analysed individually. Exon-specific PCR products are then subjected to electrophoresis on non-denaturing polyacrylamide gels such that DNA fragments migrate through the gel based on their conformation as dictated by their sequence composition. SCN1A exon-specific fragments that vary in sequence from wild-type SCN1A sequence will have a different secondary structure conformation and therefore migrate differently through the gel. Aberrantly migrating PCR products in patient samples are indicative of an alteration in the SCN1A exon and should be analysed further in secondary assays such as DNA sequencing to identify the nature of the alteration.

Additional electrophoretic assays that may be employed include RNase protection assays (Finkelstein et al., 1990; Kinszler et al., 1991) and denaturing gradient gel electrophoresis (DGGE) (Wartell et al., 1990; Sheffield et al., 1989). RNase protection involves cleavage of a mutant polynucleotide into two or more smaller fragments whereas DGGE detects differences in migration rates of mutant sequences compared to wild-type sequences, using a denaturing gradient gel.

In the RNase protection assay a labelled riboprobe which is complementary to the human wild-type SCN1A gene coding sequence is hybridised with either mRNA or DNA isolated from the patient and subsequently digested with the enzyme RNase A which is able to detect some mismatches in a duplex RNA structure. If a mismatch is detected by RNase A, it cleaves at the site of the mismatch. Thus, when the annealed RNA preparation is separated on an electrophoretic gel matrix, if a mismatch has been detected and cleaved by RNase A, an RNA product will be seen which is smaller than the full length duplex RNA for the riboprobe and the mRNA or DNA. The riboprobe need not be the full length of the SCN1A mRNA or gene but can be a segment of either. If the riboprobe comprises only a segment of the SCN1A mRNA or gene, it will be desirable to use a number of these probes to screen the whole mRNA sequence for mismatches.

In a further embodiment, enzymatic based assays (Taylor and Deeble, 1999) may be used in diagnostic applications. Such assays include the use of S1 nuclease, ribonuclease, T4 endonuclease VII, MutS (Modrich, 1991), Cleavase and MutY. In the MutS assay, the protein binds only to sequences that contain a nucleotide mismatch in a heteroduplex between mutant and wild-type sequences.

When an assay is to be based upon the SCN1A protein, a variety of approaches are possible. For example, diagnosis can be achieved by monitoring differences in the electrophoretic mobility of normal SCN1A protein and SCN1A protein isolated from a patient sample. Such an approach will be particularly useful in identifying alterations in which charge substitutions are present, or in which insertions, deletions or substitutions have resulted in a significant change in the electrophoretic migration of the resultant protein. Alternatively, diagnosis may be based upon differences in the proteolytic cleavage patterns of normal and altered proteins, differences in molar ratios of the various amino acid residues, or by functional assays demonstrating altered function of the gene products.

Further assays that are based on the SCN1A protein include immunoassays. Immunoassays for the SCN1A gene product are not currently known. However, immunoassay is included in the selection of assays because the procedures for raising antibodies against specific gene products are well described in the literature, for example in U.S. Pat. Nos. 4,172,124 and 4,474,893 which are incorporated herein by reference. Antibodies are normally raised which bind to portions of the gene product away from common mutation sites such that the same antibody binds to both mutant and normal protein. Preferred antibodies for use in this invention are monoclonal antibodies because of their improved predictability and specificity. It will be appreciated, however, that essentially any antibody which possesses the desired high level of specificity can be used, and that optimization to achieve high sensitivity is not required.

For the diagnostic detection of novel alterations in SCN1A involved in SMEI, antibodies raised to the carboxy-terminal end of the protein would be preferable. For the diagnostic detection of SCN1A alterations previously identified to be involved in SMEI, antibody raised against the defective gene product is preferable. Antibodies are added to a portion of the patient sample under conditions where an immunological reaction can occur, and the sample is then evaluated to see if such a reaction has occurred. The specific method for carrying out this evaluation is not critical and may include enzyme-linked immunosorbant assays (ELISA), described in U.S. Pat. No. 4,016,043, which is incorporated herein by reference; fluorescent enzyme immunoassay (FEIA or ELFA), which is similar to ELISA, except that a fluoregenic enzyme substrate such as 4-methylumbelliferyl-beta-galactoside is used instead of a chromogenic substrate, and radioimmunoassay (RIA).

The most definitive diagnostic assay that may be employed is DNA sequencing, and ultimately may be the only assay that is needed to be performed. Comparison of the SCN1A DNA wild-type sequence (SEQ ID NO: 125) with the SCN1A sequence of a test patient provides both high specificity and high sensitivity. The general methodology employed involves amplifying (for example with PCR) the DNA fragments of interest from patient DNA; combining the amplified DNA with a sequencing primer which may be the same as or different from the amplification primers; extending the sequencing primer in the presence of normal nucleotide (A, C, G, and T) and a chain-terminating nucleotide, such as a dideoxynucleotide, which prevents further extension of the primer once incorporated; and analyzing the product for the length of the extended fragments obtained. While such methods, which are based on the original dideoxysequencing method disclosed by Sanger et al., 1977 are useful in the present invention, the final assay is not limited to such methods. For example, other methods for determining the sequence of the gene of interest, or a portion thereof, may also be employed. Alternative methods include those described by Maxam and Gilbert (1977) and variations of the dideoxy method and methods which do not rely on chain-terminating nucleotides at all such as that disclosed in U.S. Pat. No. 4,971,903, which is incorporated herein by reference. Any sequence differences (other than benign polymorphisms) in SCN1A exons of a test patient when compared to that of the wild-type SCN1A sequence indicate a potential SMEI-causing alteration.

In a further aspect of the invention there is provided a method for the diagnosis of SMEI in a patient comprising the steps of selecting a system of assays comprising one or more assays to provide a test for the existence of an SCN1A alteration, and one or more assays to provide a test to identify the nature of the alteration, so as to determine the likelihood that it is an SMEI-associated alteration.

Application of the invention has lead to the identification of a number of mutations in the SCN1A gene in individuals that have been clinically diagnosed with SMEI. This demonstrates the utility of the diagnostic assay in providing a likelihood that an individual may be affected with SMEI.

According to a further aspect of the present invention there is provided an isolated nucleic acid molecule encoding an altered SCN1A subunit of a mammalian voltage-gated sodium channel, wherein the alteration gives rise to an SMEI phenotype and has the sequence set forth in one of SEQ ID NOS: 1-25.

In a further aspect of the present invention there is provided an isolated polypeptide, said polypeptide being an altered SCN1A subunit of a mammalian voltage-gated sodium channel, wherein the polypeptide has the amino acid sequence set forth in one of SEQ ID NOS: 26-48 and the alteration gives rise to an SMEI phenotype.

Additional alterations in the SCN1A gene were identified during this study. These alterations were identified in individuals that were not suspected of being affected with SMEI based on a clinical diagnosis.

Accordingly, in a further aspect of the present invention there is provided an isolated nucleic acid molecule encoding an altered SCN1A subunit of a mammalian voltage-gated sodium channel, wherein the alteration gives rise to a non-SMEI epilepsy phenotype and has the sequence set forth in one of SEQ ID NOS: 49-53.

In a still further aspect of the present invention there is provided an isolated polypeptide, said polypeptide being an altered SCN1A subunit of a mammalian voltage-gated sodium channel, wherein the polypeptide has the amino acid sequence set forth in one of SEQ ID NOS: 54-58 and the alteration gives rise to a non-SMEI epilepsy phenotype.

In another aspect of the present invention there is provided an isolated nucleic acid molecule comprising the nucleotide sequence set forth in any one of SEQ ID NO: 1-25, 49-53.

In another aspect of the present invention there is provided an isolated nucleic acid molecule consisting of the nucleotide sequence set forth in any one of SEQ ID NO: 1-25, 49-53.

The nucleotide sequences of the present invention can be engineered using methods accepted in the art for a variety of purposes. These include, but are not limited to, modification of the cloning, processing, and/or expression of the gene product. PCR reassembly of gene fragments and the use of synthetic oligonucleotides allow the engineering of the nucleotide sequences of the present invention. For example, oligonucleotide-mediated site-directed mutagenesis can introduce further mutations that create new restriction sites, alter expression patterns and produce splice variants etc.

As a result of the degeneracy of the genetic code, a number of polynucleotide sequences, some that may have minimal similarity to the polynucleotide sequences of any known and naturally occurring gene, may be produced. Thus, the invention includes each and every possible variation of a polynucleotide sequence that could be made by selecting combinations based on possible codon choices. These combinations are made in accordance with the standard triplet genetic code as applied to the polynucleotide sequences of the present invention, and all such variations are to be considered as being specifically disclosed.

The nucleic acid molecules of this invention are typically DNA molecules, and include cDNA, genomic DNA, synthetic forms, and mixed polymers, both sense and antisense strands, and may be chemically or biochemically modified, or may contain non-natural or derivatised nucleotide bases as will be appreciated by those skilled in the art. Such modifications include labels, methylation, intercalators, alkylators and modified linkages. In some instances it may be advantageous to produce nucleotide sequences possessing a substantially different codon usage than that of the polynucleotide sequences of the present invention. For example, codons may be selected to increase the rate of expression of the peptide in a particular prokaryotic or eukaryotic host corresponding with the frequency that particular codons are utilized by the host. Other reasons to alter the nucleotide sequence without altering the encoded amino acid sequences include the production of RNA transcripts having more desirable properties, such as a greater half-life, than transcripts produced from the naturally occurring mutated sequence.

The invention also encompasses production of nucleic acid sequences of the present invention entirely by synthetic chemistry. Synthetic sequences may be inserted into expression vectors and cell systems that contain the necessary elements for transcriptional and translational control of the inserted coding sequence in a suitable host. These elements may include regulatory sequences, promoters, 5' and 3' untranslated regions and specific initiation signals (such as an ATG initiation codon and Kozak consensus sequence) which allow more efficient translation of sequences encoding the polypeptides of the present invention. In cases where the complete coding sequence, including the initiation codon and upstream regulatory sequences, are inserted into the appropriate expression vector, additional control signals may not be needed. However, in cases where only coding sequence, or a fragment thereof, is inserted, exogenous translational control signals as described above should be provided by the vector. Such signals may be of various origins, both natural and synthetic. The efficiency of expression may be enhanced by the inclusion of enhancers appropriate for the particular host cell system used (Scharf et al., 1994).

The invention also includes nucleic acid molecules that are the complements of the sequences described herein.

The present invention allows for the preparation of purified polypeptide or protein from the polynucleotides of the present invention, or variants thereof. In order to do this, host cells may be transformed with a novel nucleic acid molecule as described above. Typically said host cells are transfected with an expression vector comprising a DNA molecule according to the invention. A variety of expression vector/host systems may be utilized to contain and express sequences encoding polypeptides of the invention. These include, but are not limited to, microorganisms such as bacteria transformed with plasmid or cosmid DNA expression vectors; yeast transformed with yeast expression vectors; insect cell systems infected with viral expression vectors (e.g., baculovirus); or mouse or other animal or human tissue cell systems. Mammalian cells can also be used to express a protein using a vaccinia virus expression system. The invention is not limited by the host cell or vector employed.

The polynucleotide sequences, or variants thereof, of the present invention can be stably expressed in cell lines to allow long term production of recombinant proteins in mammalian systems. Sequences encoding the polypeptides of the present invention can be transformed into cell lines using expression vectors which may contain viral origins of replication and/or endogenous expression elements and a selectable marker gene on the same or on a separate vector. The selectable marker confers resistance to a selective agent, and its presence allows growth and recovery of cells which successfully express the introduced sequences. Resistant clones of stably transformed cells may be propagated using tissue culture techniques appropriate to the cell type.

The protein produced by a transformed cell may be secreted or retained intracellularly depending on the sequence and/or the vector used. As will be understood by those of skill in the art, expression vectors containing polynucleotides which encode a protein may be designed to contain signal sequences which direct secretion of the protein through a prokaryotic or eukaryotic cell membrane.

In addition, a host cell strain may be chosen for its ability to modulate expression of the inserted sequences or to process the expressed protein in the desired fashion. Such modifications of the polypeptide include, but are not limited to, acetylation, glycosylation, phosphorylation, and acylation. Post-translational cleavage of a "prepro" form of the protein may also be used to specify protein targeting, folding, and/or activity. Different host cells having specific cellular machinery and characteristic mechanisms for post-translational activities (e.g., CHO or HeLa cells), are available from the American Type Culture Collection (ATCC) and may be chosen to ensure the correct modification and processing of the foreign protein.

When large quantities of the protein product of the gene are needed, such as for antibody production, vectors which direct high levels of expression of this protein may be used, such as those containing the T5 or T7 inducible bacteriophage promoter. The present invention also includes the use of the expression systems described above in generating and isolating fusion proteins which contain important functional domains of the protein. These fusion proteins are used for binding, structural and functional studies as well as for the generation of appropriate antibodies.

In order to express and purify the protein as a fusion protein, the appropriate cDNA sequence is inserted into a vector which contains a nucleotide sequence encoding another peptide (for example, glutathionine succinyl transferase). The fusion protein is expressed and recovered from prokaryotic or eukaryotic cells. The fusion protein can then be purified by affinity chromatography based upon the fusion vector sequence. The desired protein is then obtained by enzymatic cleavage of the fusion protein.

Fragments of the polypeptides of the present invention may also be produced by direct peptide synthesis using solid-phase techniques. Automated synthesis may be achieved by using the ABI 431A Peptide Synthesizer (Perkin-Elmer). Various fragments of this protein may be synthesized separately and then combined to produce the full-length molecule.

In another aspect of the present invention there is provided an isolated polypeptide comprising the amino acid sequence set forth in any one of SEQ ID Numbers: 26-48, 54-58.

In another aspect of the present invention there is provided an isolated polypeptide consisting of the amino acid sequence set forth in any one of SEQ ID NO: 26-48, 54-58.

According to still another aspect of the invention, there is provided a mammalian voltage-gated sodium channel that incorporates an altered SCN1A protein as described above.

According to still another aspect of the present invention there is provided an expression vector comprising a nucleic acid molecule as described above.

According to still another aspect of the present invention there is provided a cell comprising a nucleic acid molecule as described above.

According to still another aspect of the present invention there is provided a method of preparing a polypeptide, said polypeptide being an altered SCN1A protein of a mammalian voltage-gated sodium channel, comprising the steps of:
  (1) culturing a cell as described above under conditions effective for polypeptide production; and
  (2) harvesting the polypeptide.

The mutant SCN1A protein may be allowed to assemble with other subunits of the sodium channel that are co-expressed by the cell (such as the SCN1B protein), whereby the assembled altered sodium channel is harvested.

According to still another aspect of the invention there is provided a polypeptide which is the product of the process described above.

Substantially purified protein or fragments thereof can then be used in further biochemical analyses to establish secondary and tertiary structure. Such methodology is known in the art and includes, but is not restricted to, X-ray crystallography of crystals of the proteins or of the assembled ion channel incorporating the proteins or by nuclear magnetic resonance (NMR). Determination of structure allows for the rational design of pharmaceuticals to interact with the altered sodium channel as a whole or through interaction with the altered SCN1A protein of the channel (see drug screening below), alter the overall sodium channel protein charge configuration or charge interaction with other proteins, or to alter its function in the cell.

It will be appreciated that having identified novel alterations in the SCN1A gene responsible for epilepsy, including SMEI, the altered SCN1A proteins will enable therapeutic methods for the treatment of epilepsy, including SMEI.

Therapeutic Applications

According to still another aspect of the invention there is provided a method of treating epilepsy, including SMEI, comprising administering a selective antagonist, agonist or modulator of an SCN1A polypeptide as described above to a subject in need of such treatment.

In still another aspect of the invention there is provided the use of a selective antagonist, agonist or modulator of an SCN1A polypeptide as described above in the manufacture of a medicament for the treatment of epilepsy, including SMEI.

In one aspect, a suitable antagonist, agonist or modulator will restore wild-type function to sodium channels containing SCN1A alterations that form part of this invention, or will negate the effects the altered receptor has on cell function.

Using methods well known in the art, an altered sodium channel, or SCN1A protein of the channel, that is causative of epilepsy, including SMEI, may be used to produce antibodies specific for the altered channel or SCN1A protein of the channel or to screen libraries of pharmaceutical agents to identify those that bind the altered channel or SCN1A protein of the channel.

In one aspect, an antibody, which specifically binds to an altered sodium channel or altered SCN1A protein of the invention, may be used directly as an agonist, antagonist or modulator, or indirectly as a targeting or delivery mechanism for bringing a pharmaceutical agent to cells or tissues that express the altered channel.

In a still further aspect of the invention there is provided an antibody which is immunologically reactive with a polypeptide as described above, but not with a wild-type SCN1A channel or SCN1A protein thereof.

In particular, there is provided an antibody to an assembled sodium channel containing an alteration in the SCN1A protein that forms part of the channel, which is causative of epilepsy, including SMEI. Such antibodies may include, but are not limited to, polyclonal, monoclonal, chimeric, and single chain antibodies as would be understood by the person skilled in the art.

For the production of antibodies, various hosts including rabbits, rats, goats, mice, humans, and others may be immunized by injection with a polypeptide as described above or with any fragment or oligopeptide thereof which has immunogenic properties. Various adjuvants may be used to increase immunological response and include, but are not limited to, Freund's, mineral gels such as aluminium hydroxide, and surface-active substances such as lysolecithin. Adjuvants used in humans include BCG (bacilli Calmette-Guerin) and *Corynebacterium parvum*.

It is preferred that the oligopeptides, peptides, or fragments used to induce antibodies to the altered sodium channel, or altered SCN1A protein thereof, have an amino acid sequence consisting of at least 5 amino acids, and, more preferably, of at least 10 amino acids. It is also preferable that these oligopeptides, peptides, or fragments are identical to a portion of the amino acid sequence of the natural protein and contain the entire amino acid sequence of a small, naturally occurring molecule. Short stretches of SCN1A amino acids may be fused with those of another protein, such as KLH, and antibodies to the chimeric molecule may be produced.

Monoclonal antibodies to an altered sodium channel, or altered SCN1A protein thereof, may be prepared using any technique which provides for the production of antibody molecules by continuous cell lines in culture. These include, but are not limited to, the hybridoma technique, the human B-cell hybridoma technique, and the EBV-hybridoma technique. (For example, see Kohler et al., 1975; Kozbor et al., 1985; Cote et al., 1983; Cole et al., 1984).

Monoclonal antibodies produced may include, but are not limited to, mouse-derived antibodies, humanised antibodies and fully human antibodies.

Antibodies may also be produced by inducing in vivo production in the lymphocyte population or by screening immunoglobulin libraries or panels of highly specific binding reagents as disclosed in the literature. (For example, see Orlandi et al., 1989; Winter and Milstein, 1991).

Antibody fragments which contain specific binding sites for an altered sodium channel, or altered SCN1A protein thereof, may also be generated. For example, such fragments include, F(ab')$_2$ fragments produced by pepsin digestion of the antibody molecule and Fab fragments generated by reducing the disulfide bridges of the F(ab')$_2$ fragments. Alternatively, Fab expression libraries may be constructed to allow rapid and easy identification of monoclonal Fab fragments with the desired specificity. (For example, see Huse et al., 1989).

Various immunoassays may be used for screening to identify antibodies having the desired specificity. Numerous protocols for competitive binding or immunoradiometric assays using either polyclonal or monoclonal antibodies with established specificities are well known in the art. Such immunoassays typically involve the measurement of complex formation between an ion channel and its specific antibody. A two-site, monoclonal-based immunoassay utilizing antibodies reactive to two non-interfering sodium channel epitopes is preferred, but a competitive binding assay may also be employed.

In a further aspect of the invention there is provided a method of treating epilepsy, including SMEI comprising administering an isolated nucleic acid molecule which is the complement (antisense) of any one of the nucleic acid molecules described above and which encodes an RNA molecule that hybridizes with the mRNA encoding an altered SCN1A of the invention, to a subject in need of such treatment.

In a still further aspect of the invention there is provided the use of an isolated nucleic acid molecule which is the complement (antisense) of a nucleic acid molecule of the invention and which encodes an RNA molecule that hybridizes with the mRNA encoding an altered SCN1A of the invention, in the manufacture of a medicament for the treatment of epilepsy, including SMEI.

Typically, a vector expressing the complement (antisense) of the polynucleotides of the invention may be administered to a subject in need of such treatment. Many methods for introducing vectors into cells or tissues are available and equally suitable for use in vivo, in vitro, and ex vivo. For ex vivo therapy, vectors may be introduced into stem cells taken from the patient and clonally propagated for autologous transplant back into that same patient. Delivery by transfection, by liposome injections, or by polycationic amino polymers may be achieved using methods which are well known in the art. (For example, see Goldman et al., 1997).

Additional antisense or gene-targeted silencing strategies may include, but are not limited to, the use of antisense oligonucleotides, injection of antisense RNA, transfection of antisense RNA expression vectors, and the use of RNA interference (RNAi) or short interfering RNAs (siRNA). Still further, catalytic nucleic acid molecules such as DNAzymes and ribozymes may be used for gene silencing (Breaker and Joyce, 1994; Haseloff and Gerlach, 1988). These molecules function by cleaving their target mRNA molecule rather than merely binding to it as in traditional antisense approaches.

In a further aspect, a suitable agonist, antagonist or modulator may include peptides, phosphopeptides or small organic or inorganic compounds that can restore wild-type activity of sodium channels containing alterations in SCN1A protein of the receptor as described above.

Peptides, phosphopeptides or small organic or inorganic compounds suitable for therapeutic applications may be identified using nucleic acids and peptides of the invention in drug screening applications as described below. Molecules identified from these screens may also be of therapeutic application in affected individuals carrying other sodium channel alterations, or individuals carrying alterations in genes other than those comprising the sodium channel, if the molecule is able to correct the common underlying functional deficit imposed by these alterations and those of the invention.

There is therefore provided a method of treating epilepsy, including SMEI comprising administering a compound that is a suitable agonist, antagonist or modulator of a sodium channel and that has been identified using altered SCN1A of the invention.

In some instances, an appropriate approach for treatment may be combination therapy. This may involve the administering an antibody, an agonist, antagonist or modulator, or complement (antisense) to an altered sodium channel, or altered SCN1A protein thereof, of the invention to inhibit its functional effect, combined with administration of wild-type SCN1A which may restore levels of wild-type sodium channel formation to normal levels. Wild-type SCN1A can be administered using gene therapy approaches as described above for complement administration.

There is therefore provided a method of treating epilepsy, including SMEI comprising administration of an antibody, an agonist, antagonist or modulator, or complement to an altered sodium channel, or altered SCN1A protein thereof, of the invention in combination with administration of wild-type SCN1A.

In still another aspect of the invention there is provided the use of an antibody, an agonist, antagonist or modulator, or complement to an altered sodium channel, or altered SCN1A protein thereof, of the invention in combination with the use of wild-type SCN1A, in the manufacture of a medicament for the treatment of epilepsy, including SMEI.

In further embodiments, any of the agonists, antagonists, modulators, antibodies, complementary sequences or vectors of the invention may be administered alone or in combination with other appropriate therapeutic agents. Selection of the appropriate agents may be made by those skilled in the art, according to conventional pharmaceutical principles. The combination of therapeutic agents may act synergistically to effect the treatment or prevention of the various disorders described above. Using this approach, therapeutic efficacy with lower dosages of each agent may be possible, thus reducing the potential for adverse side effects.

Any of the therapeutic methods described above may be applied to any subject in need of such therapy, including, for example, mammals such as dogs, cats, cows, horses, rabbits, monkeys, and most preferably, humans.

Drug Screening

According to still another aspect of the invention, nucleic acid molecules of the invention as well as peptides of the invention, particularly purified altered SCN1A protein and cells expressing these, are useful for the screening of candidate pharmaceutical compounds for the treatment of epilepsy, including SMEI.

Still further, it provides the use of an altered sodium channel polypeptide complex for the screening of candidate pharmaceutical compounds.

Still further, it provides the use wherein high throughput screening techniques are employed.

Compounds that can be screened in accordance with the invention include, but are not limited to peptides (such as soluble peptides), phosphopeptides and small organic or inorganic molecules (such as natural product or synthetic chemical libraries and peptidomimetics).

In one embodiment, a screening assay may include a cell-based assay utilising eukaryotic or prokaryotic host cells that are stably transformed with recombinant molecules expressing the polypeptides or fragments of the invention, in competitive binding assays. Binding assays will measure the formation of complexes between an altered sodium channel, or altered SCN1A protein thereof, and the compound being tested, or will measure the degree to which a compound being tested will inhibit or restore the formation of a complex between an altered sodium channel, or altered SCN1A protein thereof, and its interactor or ligand.

The invention is particularly useful for screening compounds by using the polypeptides of the invention in transformed cells, transfected or injected oocytes, or animal models bearing altered SCN1A such as transgenic animals or gene targeted (knock-in) animals (see transformed hosts). Drug candidates can be added to cultured cells that express an altered SCN1A protein (appropriate wild-type sodium channel subunits such as SCN1B should also be expressed for receptor assembly), can be added to oocytes transfected or injected with an altered SCN1A protein (appropriate wild-type sodium channel subunits such as SCN1B must also be injected for receptor assembly), or can be administered to an animal model expressing an altered SCN1A protein. Determining the ability of the test compound to modulate altered sodium channel activity can be accomplished by a number of techniques known in the art. These include for example measuring the effect on the current of the channel as compared to the current of a cell or animal containing the wild-type sodium channel.

Current in cells can be measured by a number of approaches including the patch-clamp technique (methods described in Hamill et al, 1981) or using fluorescence based assays as are known in the art (see Gonzalez et al., 1999). Drug candidates that alter the current to a more normal level are useful for treating or preventing epilepsy, including SMEI.

Non cell-based assays may also be used for identifying compounds that can inhibit or restore binding between the altered sodium channel, or altered SCN1A protein thereof, of the invention, and their interactors. Such assays are known in the art and include for example AlphaScreen technology (PerkinElmer Life Sciences, MA, USA). This application relies on the use of beads such that each interaction partner is bound to a separate bead via an antibody. Interaction of each partner will bring the beads into proximity, such that laser excitation initiates a number of chemical reactions ultimately leading to fluorophores emitting a light signal. Candidate compounds that inhibit the binding of the altered sodium channel, or altered SCN1A protein thereof, with its interactor will result in loss of light emission, while candidate compounds that restore the binding of the altered sodium channel, or altered SCN1A protein thereof, with its interactor will result in positive light emission. These assays ultimately enable identification and isolation of the candidate compounds.

High-throughput drug screening techniques may also employ methods as described in WO84/03564. Small peptide test compounds synthesised on a solid substrate can be assayed for altered SCN1A protein or altered sodium channel binding. Bound altered sodium channel or altered SCN1A polypeptide is then detected by methods well known in the art. In a variation of this technique, purified polypeptides of the invention can be coated directly onto plates to identify interacting test compounds.

The invention also contemplates the use of competition drug screening assays in which neutralizing antibodies capable of specifically binding the altered sodium channel compete with a test compound for binding thereto. In this manner, the antibodies can be used to detect the presence of any peptide that shares one or more antigenic determinants of the altered receptor.

The polypeptides of the present invention may also be used for screening compounds developed as a result of combinatorial library technology. This provides a way to test a large number of different substances for their ability to modulate activity of a polypeptide. A substance identified as a modulator of polypeptide function may be peptide or non-peptide in nature. Non-peptide "small molecules" are often preferred for many in vivo pharmaceutical applications. In addition, a mimic or mimetic of the substance may be designed for pharmaceutical use. The design of mimetics based on a known pharmaceutically active compound ("lead" compound) is a common approach to the development of novel pharmaceuticals. This is often desirable where the original active compound is difficult or expensive to synthesise or where it provides an unsuitable method of administration. In the design of a mimetic, particular parts of the original active compound that are important in determining the target property are identified. These parts or residues constituting the active region of the compound are known as its pharmacophore. Once found, the pharmacophore structure is modelled according to its physical properties using data from a range of sources including x-ray diffraction data and NMR. A template molecule is then selected onto which chemical groups which mimic the pharmacophore can be added. The selection can be made such that the mimetic is easy to synthesise, is likely to be pharmacologically acceptable, does not degrade in vivo and retains the biological activity of the lead compound. Further optimisation or modification can be carried out to select one or more final mimetics useful for in vivo or clinical testing.

It is also possible to isolate a target-specific antibody and then solve its crystal structure. In principle, this approach yields a pharmacophore upon which subsequent drug design can be based as described above. It may be possible to avoid protein crystallography altogether by generating anti-idiotypic antibodies (anti-ids) to a functional, pharmacologically active antibody. As a mirror image of a mirror image, the binding site of the anti-ids would be expected to be an analogue of the original receptor. The anti-id could then be used to isolate peptides from chemically or biologically produced peptide banks.

Another alternative method for drug screening relies on structure-based rational drug design. Determination of the three dimensional structure of the polypeptides of the invention, or the three dimensional structure of the GABA-B receptors which incorporate these polypeptides allows for structure-based drug design to identify biologically active lead compounds.

Three dimensional structural models can be generated by a number of applications, some of which include experimental models such as x-ray crystallography and NMR and/or from in silico studies of structural databases such as the Protein Databank (PDB). In addition, three dimensional structural models can be determined using a number of known protein structure prediction techniques based on the primary sequences of the polypeptides (e.g. SYBYL—Tripos Associated, St. Louis, Mo.), de novo protein structure design programs (e.g. MODELER—MSI Inc., San Diego, Calif., or MOE—Chemical Computing Group, Montreal, Canada) or ab initio methods as described, for example, in U.S. Pat. Nos. 5,331,573 and 5,579,250, the contents of which are incorporated herein by reference.

Once the three dimensional structure of a polypeptide or polypeptide complex has been determined, structure-based drug discovery techniques can be employed to design biologically-active compounds based on these three dimensional structures. Such techniques are known in the art and include examples such as DOCK (University of California, San Francisco) or AUTODOCK (Scripps Research Institute, La Jolla, Calif.). A computational docking protocol will identify the active site or sites that are deemed important for protein activity based on a predicted protein model. Molecular databases, such as the Available Chemicals Directory (ACD) are then screened for molecules that complement the protein model.

Using methods such as these, potential clinical drug candidates can be identified and computationally ranked in order to reduce the time and expense associated with typical 'wet lab' drug screening methodologies.

Compounds identified through screening procedures as described above, and which are based on the use of the altered nucleic acid and polypeptides of the invention, can also be tested for their effect on correcting the functional deficit imposed by other gene alterations in affected individuals including other SCN1A alterations.

Such compounds form a part of the present invention, as do pharmaceutical compositions containing these and a pharmaceutically acceptable carrier.

Pharmaceutical Preparations

Compounds identified from screening assays and shown to restore sodium channel wild-type activity can be administered to a patient at a therapeutically effective dose to treat or ameliorate epilepsy, including SMEI, as described above. A therapeutically effective dose refers to that amount of the compound sufficient to result in amelioration of symptoms of the disorder.

Toxicity and therapeutic efficacy of such compounds can be determined by standard pharmaceutical procedures in cell cultures or experimental animals. The data obtained from these studies can then be used in the formulation of a range of dosages for use in humans.

Pharmaceutical compositions for use in accordance with the present invention can be formulated in a conventional manner using one or more physiological acceptable carriers, excipients or stabilisers which are well known. Acceptable carriers, excipients or stabilizers are non-toxic at the dosages and concentrations employed, and include buffers such as phosphate, citrate, and other organic acids; antioxidants including absorbic acid; low molecular weight (less than about 10 residues) polypeptides; proteins, such as serum albumin, gelatin, or immunoglobulins; binding agents including hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or non-ionic surfactants such as Tween, Pluronics or polyethylene glycol (PEG).

The formulation of pharmaceutical compositions for use in accordance with the present invention will be based on the proposed route of administration. Routes of administration may include, but are not limited to, inhalation, insufflation (either through the mouth or nose), oral, buccal, rectal or parental administration.

Microarray

In further embodiments, complete cDNAs, oligonucleotides or longer fragments derived from any of the SCN1A polynucleotide sequences described herein may be used as probes in a microarray. The microarray can be used to diagnose epilepsy, including SMEI, through the identification of the SCN1A alterations of the invention, to understand the genetic basis of epilepsy, or can be used to develop and monitor the activities of therapeutic agents.

According to a further aspect of the present invention, tissue material obtained from animal models (see below) generated as a result of the identification of specific SCN1A human alterations of the present invention, can be used in microarray experiments. These experiments can be conducted to identify the level of expression of SCN1A, or the level of expression of any cDNA clone from whole-tissue libraries, in diseased tissue as opposed to normal control tissue. Variations in the expression level of genes, including SCN1A, between the two tissues indicates their possible involvement in the disease process either as a cause or consequence of the original SCN1A alteration present in the animal model. These experiments may also be used to determine gene function, to understand the genetic basis of epilepsy, to diagnose epilepsy, and to develop and monitor the activities of therapeutic agents. Microarrays may be prepared, used, and analyzed using methods known in the art. (For example, see Schena et al., 1996; Heller et al., 1997).

Transformed Hosts

The present invention also provides for genetically modified (knock-out, knock-in and transgenic), non-human animal models comprising nucleic acid molecules of the invention. These animals are useful for the study of the function of a sodium channel, to study the mechanisms of epilepsy as related to a sodium channel, for the screening of candidate pharmaceutical compounds, for the creation of explanted mammalian cell cultures which express altered sodium channels, and for the evaluation of potential therapeutic interventions.

Animal species which are suitable for use in the animal models of the present invention include, but are not limited to, rats, mice, hamsters, guinea pigs, rabbits, dogs, cats, goats, sheep, pigs, and non-human primates such as monkeys and chimpanzees. For initial studies, genetically modified mice and rats are highly desirable due to the relative ease in generating knock-in, knock-out or transgenics of these animals, their ease of maintenance and their shorter life spans. For certain studies, transgenic yeast or invertebrates may be suitable and preferred because they allow for rapid screening and provide for much easier handling. For longer term studies, non-human primates may be desired due to their similarity with humans.

To create an animal model for an altered sodium channel of the invention, several methods can be employed. These include, but are not limited to, generation of a specific alteration in a homologous animal gene, insertion of a wild type human gene and/or a humanized animal gene by homologous recombination, insertion of an altered human gene as genomic or minigene cDNA constructs using wild type or altered or artificial promoter elements, or insertion of artificially modified fragments of the endogenous gene by homologous recombination. The modifications include insertion of mutant stop codons, the deletion of DNA sequences, or the inclusion of recombination elements (lox p sites) recognized by enzymes such as Cre recombinase.

To create transgenic mice in order to study gain of gene function in vivo, a SCN1A alteration of the invention can be inserted into a mouse germ line using standard techniques such as oocyte microinjection. Gain of gene function can mean the over-expression of a gene and its protein product, or the genetic complementation of a mutation of the gene under investigation. For oocyte injection, one or more copies of the mutant gene can be inserted into the pronucleus of a just-fertilized mouse oocyte. This oocyte is then reimplanted into a pseudo-pregnant foster mother. The live-born mice can then be screened for integrants using analysis of tail DNA for the presence of the relevant human SCN1A gene sequence. The transgene can be either a complete genomic sequence injected as a YAC, BAC, PAC or other chromosome DNA fragment, a cDNA with either the natural promoter or a heterologous promoter, or a minigene containing all of the coding region and other elements found to be necessary for optimum expression.

To generate knock-out mice or knock-in mice, gene targeting through homologous recombination in mouse embryonic stem (ES) cells may be applied. Knock-out mice are generated to study loss of gene function in vivo while knock-in mice (which are preferred) allow the study of gain of function or to study the effect of specific gene mutations. Knock-in mice are similar to transgenic mice however the integration site and copy number are defined in the former.

For knock-out mouse generation, gene targeting vectors can be designed such that they delete (knock-out) the protein coding sequence of the SCN1A gene in the mouse genome. In contrast, knock-in mice can be produced whereby a gene targeting vector containing the relevant altered SCN1A gene can integrate into a defined genetic locus in the mouse genome. For both applications, homologous recombination is catalysed by specific DNA repair enzymes that recognise homologous DNA sequences and exchange them via double crossover.

Gene targeting vectors are usually introduced into ES cells using electroporation. ES cell integrants are then isolated via an antibiotic resistance gene present on the targeting vector and are subsequently genotyped to identify those ES cell clones in which the gene under investigation has integrated into the locus of interest. The appropriate ES cells are then transmitted through the germline to produce a novel mouse strain.

In instances where gene ablation results in early embryonic lethality, conditional gene targeting may be employed. This allows genes to be deleted in a temporally and spatially controlled fashion. As above, appropriate ES cells are transmitted through the germline to produce a novel mouse strain, however the actual deletion of the gene is performed in the adult mouse in a tissue specific or time controlled manner. Conditional gene targeting is most commonly achieved by use of the cre/lox system. The enzyme cre is able to recognise the 34 base pair loxP sequence such that loxP flanked (or floxed) DNA is recognised and excised by cre. Tissue specific cre expression in transgenic mice enables the generation of tissue specific knock-out mice by mating gene targeted floxed mice with cre transgenic mice. Knock-out can be conducted in every tissue (Schwenk et al., 1995) using the 'deleter' mouse or using transgenic mice with an inducible cre gene (such as those with tetracycline inducible cre genes), or knock-out can be tissue specific for example through the use of the CD19-cre mouse (Rickert et al., 1997).

According to still another aspect of the invention there is provided the use of genetically modified non-human animals as described above for the screening of candidate pharmaceutical compounds (see drug screening above). These animals are also useful for the evaluation (e.g. therapeutic efficacy, toxicity, metabolism) of candidate pharmaceutical compounds, including those identified from the invention as described above, for the treatment of epilepsy, including SMEI.

Throughout this specification and the claims, the words "comprise", "comprises" and "comprising" are used in a non-exclusive sense, except where the context requires otherwise.

It will be apparent to the person skilled in the art that while the invention has been described in some detail for the purposes of clarity and understanding, various modifications and alterations to the embodiments and methods described herein may be made without departing from the scope of the inventive concept disclosed in this specification.

Modes for Performing the Invention

Any combination of assay systems described above may be employed for the identification of SCN1A mutations potentially causative of SMEI. Provided below are examples of assays that may be employed.

Example 1

Patient DNA Collection

The flowchart in FIG. 1 illustrates a strategy based on the invention that can be used to determine the likelihood that an alteration in the SCN1A gene is responsible for SMEI. The assay combination chosen is preceded by selecting the patient population to be examined and obtaining DNA from the sample population. The sample population may encompass any individual with epilepsy but would likely focus on children with febrile seizures as well as other patients that are suspected to have myoclonic epilepsy. For the present study, the patient population chosen included individuals that had been diagnosed with SMEI from a clinical analysis or had severe encephalopathies occurring during the first 12 months of life.

DNA from a test patient may be obtained in a number of ways. The most common approach is to obtain DNA from blood samples taken from the patient, however DNA may also be obtained using less invasive approaches such as from cheek cell swabs.

For the current study DNA was extracted from collected blood using the QIAamp DNA Blood Maxi kit (Qiagen) according to manufacturers specifications or through procedures adapted from Wyman and White (1980). For DNA samples obtained using the QIAamp kit, a final ethanol precipitation step was employed with DNA pellets being resuspended in sterile water. Stock DNA samples were kept at a concentration of 200 ng/ul and 100 ng/ul dilutions were prepared for subsequent PCR reactions.

Example 2 dHPLC Assay

Once DNA was obtained from the patients, PCR amplification of individual exons of the SCN1A gene was employed prior to analysis by high performance liquid chromatography (dHPLC). The SCN1A gene has 26 exons for which primers were designed to amplify 33 amplicons. Each exon was amplified by a single amplicon except for exons 11, 15 and 16 which are amplified in two amplicons respectively and exon 26 where 5 amplicons were used to amplify the entire exon. Table 1 provides a list of primers that were designed to analyse each exon of the SCN1A gene.

PCR amplification reactions were performed in a volume of 20 ul and were prepared in 96-well plates. For the majority of amplicons the PCR reaction consisted of 1×PCR buffer (Invitrogen), 200 UM dNTPs, 300 ng of each primer, 1.5 mM $MgCl_2$, 100 ng DNA and 0.5 units of Taq DNA polymerase (Invitrogen). The above conditions were used for all amplicons except for exon 5, and 26(1) where 1 Unit of Taq DNA polymerase was used.

The thermal cycling conditions employed for PCR amplification varied according to each exon. For exons 1-4, 6-9, 11(1), 11(2), 12, 14, 15(1), 15(2), 16(2), 19, and 22-24, PCR reactions were performed using 1 cycle of 94° C. for 2 minutes, followed by 10 cycles of 60° C. for 30 seconds, 72° C. for 30 seconds, and 94° C. for 30 seconds, followed by 25 cycles of 55° C. for 30 seconds, 72° C. for 30 seconds, and 94° C. for 30 seconds. A final annealing reaction at 55° C. for 30 seconds followed by an extension reaction for 10 minutes at 72° C. completed the cycling conditions for these amplicons.

For exon 5, the same conditions were employed as above except the annealing temperature was 62° C. for 10 cycles and then 58° C. for 25 cycles.

For exons 10, 16(1), 21, 25, 26(1), 26(2), 26(3), 26(4), and 26(5), PCR reactions were performed using 1 cycle of 94° C. for 2 minutes, followed by 10 cycles of 60° C. for 1.5 minutes, 72° C. for 1.5 minutes, and 94° C. for 1.5 minutes, followed by 25 cycles of 55° C. for 1.5 minutes, 72° C. for 1.5 minutes, and 94° C. for 1.5 minutes. A final annealing reaction at 55° C. for 1.5 minutes followed by an extension reaction for 10 minutes at 72° C. completed the cycling conditions for these amplicons.

For exons 17, 18 and 20, PCR reactions were performed using 1 cycle of 94° C. for 2 minutes, followed by 35 cycles of 50° C. for 30 seconds, 72° C. for 30 seconds, and 94° C. for 30 seconds. A final annealing reaction at 50° C. for 30 seconds followed by an extension reaction for 10 minutes at 72° C. completed the cycling conditions for these amplicons.

For exon 13, PCR reactions were performed using 1 cycle of 94° C. for 2 minutes, followed by 10 cycles of 94° C. for 1 minute, 64° C. for 1.5 minutes, and 72° C. for 1.5 minutes, followed by 25 cycles of 94° C. for 1 minute, 60° C. for 1.5 minutes, and 72° C. for 1.5 minutes. This was followed by a final extension reaction for 10 minutes at 72° C. to complete the cycling conditions for this amplicon.

Prior to dHPLC analysis, PCR products were heated to 95° C. for 5 minutes and are then slowly cooled at −3° C. increments for 1.5 minutes (until 25° C. is reached). This is to allow the formation of hetero- and homoduplexes depending upon the nucleotide constitution of the PCR product.

Various dHPLC systems can be used for heteroduplex analysis and mutation detection. This study used the Transgenomic WAVE® System and the methodology supplied with the system. In order to detect mutations on the dHPLC each product needed to be run under partially denaturing conditions. Due to each amplicon of the SCN1A gene having a different sequence, the temperature(s) at which each product is partially denatured needed to be calculated. Using the Transgenomic software supplied with the dHPLC system the required temperatures for each of the amplicons was determined and is shown in Table 2.

Amplicons are fed through the dHPLC column according to manufacturers conditions and computer generated chromatograms are compared between patient samples and wild-type samples. The analysis is done by visually looking at the chromatograms and also using the mutation detection Transgenomic software supplied with the HPLC. Those patient samples showing different peak patterns to wild-type are considered to contain alterations in the SCN1A amplicon under investigation and the DNA from those individuals was subject to a further assay, namely DNA sequencing (see example 3 below), to determine the nature of the SCN1A alteration and to predict the likelihood that the alteration was responsible for SMEI.

Example 3

DNA Sequencing Assay

PCR products from the dHPLC analysis that showed different peak patterns to wild-type may be subject to secondary assays such as DNA sequencing to identify the nature of the alteration. In the present study DNA sequencing was employed. This first involved re-amplification of the amplicon displaying an altered dHPLC chromatogram from the relevant individual followed by purification of the PCR amplified templates for sequencing using QiaQuick PCR preps (Qiagen) based on manufacturers procedures. The primers used to sequence the purified amplicons were identical to those used for the initial amplification step. For each sequencing reaction, 25 ng of primer and 100 ng of purified PCR template were used. The BigDye sequencing kit (ABI) was used for all sequencing reactions according to the manufacturers specifications. The products were run on an ABI 377 Sequencer and analysed using the EditView program.

A comparison of the DNA sequence obtained from the patient sample was then made directly to that of the wild-type SCN1A sequence in order to identify the nature of the DNA alteration that lead to the change detected by dHPLC.

The results of the screening of 26 of the 33 amplicons of the SCN1A gene are shown in Table 3. A total of 96 patients were analysed with their clinical epilepsy phenotype being hidden during the analysis. A total of 34 samples were shown to have an alteration in the SCN1A gene and of these, 28 samples had a clear SMEI phenotype based on a clinical analysis. Four of the SCN1A alterations (M1780T, R222X, R1407X, R1892X) that were identified are not shown in Table 3 as they had previously been associated with SMEI (Nabbout et al., 2003; Claes et al., 2001; Sugawara et al., 2002). It can therefore be determined that if an SCN1A alteration is found in a patient, then the patient has an 82% chance (28/34) of having SMEI.

This likelihood would increase if the alteration identified was one that had previously been associated with SMEI. In addition, based on current opinion (Mulley et al., 2003) the likelihood would further increase if the alteration is not seen in the parents or relatives of the affected individual (i.e. is a de novo alteration) and is still further increased if the alteration is found to result in a major disruption to the protein (such as a truncating alteration). The ability to provide this level of certainty as to a diagnosis of SMEI will be of benefit when considering therapy regimes for the patient and the avoidance of seizure aggravation induced by such factors as fever associated with vaccinations and other causes.

Example 4

Additional Assays—SSCP Assay

In addition to the assays described above, other assays may be employed to test for the existence of alterations in the SCN1A gene that are associated with SMEI. One such assay is single strand conformation polymorphism (SSCP) analysis. In this technique, DNA obtained from the patient is first PCR amplified for individual exons of the SCN1A gene. The primers employed for dHPLC analysis (see Table 1) may also be used for SSCP analysis.

In some instances the primers used for SSCP analysis are labelled at their 5' end with HEX for a fluorescent-based detection approach as used for example in the GelScan 2000 system (Corbett Research, Australia). SSCP PCR reactions and cycling conditions can be performed as described above for dHPLC analysis, however any PCR reaction and cycling conditions may be employed provided that the amplification produces a distinct product specific for the amplicon under investigation only.

An example of alternative PCR reaction conditions are where the reaction is performed in a total volume of 10 µl containing 67 mM Tris-HCl (pH 8.8); 16.5 mM $(NH_4)_2SO_4$; 6.5 µm EDTA; 1.5 mM $MgCl_2$; 200 µm each dNTP; 10% DMSO; 0.17 mg/ml BSA; 10 mM β-mercaptoethanol; 5 µg/ml each primer and 100 U/ml Taq DNA polymerase. PCR cycling conditions may use 10 cycles of 94° C. for 30 seconds, 60° C. for 30 seconds, and 72° C. for 30 seconds followed by 25 cycles of 94° C. for 30 seconds, 55° C. for 30 seconds, and 72° C. for 30 seconds. A final extension reaction for 10 minutes at 72° C. should follow.

Twenty µl of loading dye comprising 50% (v/v) formamide, 12.5 mM EDTA and 0.02% (w/v) bromophenol blue is then added to completed reactions which are subsequently run on non-denaturing 4% polyacrylamide gels with a cross-linking ratio of 35:1 (acrylamide:bis-acrylamide) and containing 2% glycerol. For analysis of PCR amplicons using the GelScan 2000 system, the gel thickness typically employed is 100 µm, with a width of 168 mm and length of 160 mm. Gels are normally run at 1200 volts and approximately 20 mA, at 22° C. and analysed on the GelScan 2000 system according to manufacturers specifications. Those amplicons that contain alterations in the SCN1A sequence will migrate through the gel differently than wild-type amplicons due to their altered single strand conformation. A further assay such as DNA sequencing may then be employed (see example 3 above) to determine the nature of the SCN1A alteration in the amplicon.

TABLE 1

Primer Sequences Used for dHPLC Assay Analysis of SCN1A

| Exon | Forward Primer | Reverse Primer | Size (bp) | SEQ ID NO |
|---|---|---|---|---|
| 1 | CCTCTAGCTCATGTTTCATGAC | TGCAGTAGGCAATTAGCAGC | 448 | 59, 60 |
| 2 | CTAATTAAGAAGAGATCCAGTGACAG | GCTATAAAGTGCTTACAGATCATGTAC | 356 | 61, 62 |
| 3 | CCCTGAATTTTGGCTAAGCTGCAG | CTACATTAAGACACAGTTTCAAAATCC | 263 | 63, 64 |
| 4 | GGGCTACGTTTCATTTGTATG | GCAACCTATTCTTAAAGCATAAGACTG | 358 | 65, 66 |
| 5 | AGGCTCTTTGTACCTACAGC | CATGTAGGGTCCGTCTCATT | 200 | 67, 68 |
| 6 | CACACGTGTTAAGTCTTCATAGT | AGCCCCTCAAGTATTTATCCT | 394 | 69, 70 |
| 7 | GAACCTGACCTTCCTGTTCTC | GTTGGCTGTTATCTTCAGTTTC | 241 | 71, 72 |
| 8 | AAAGGCAGCAGAACGACTTG | GGATAGAGGAACTCAAGTCTC | 322 | 73, 74 |

TABLE 1-continued

Primer Sequences Used for dHPLC Assay Analysis of SCN1A

| Exon | Forward Primer | Reverse Primer | Size (bp) | SEQ ID NO |
|---|---|---|---|---|
| 9 | TTGAAAGTTGAAGCCACCAC | CCACCTGCTCTTAGGTACTC | 363 | 75, 76 |
| 10 | GCCATGCAAATACTTCAGCCC | CACAACAGTGGTTGATTCAGTTG | 480 | 77, 78 |
| 11(1) | TGAATGCTGAAATCTCCTTCTAC | CTCAGGTTGCTGTTGCGTCTC | 306 | 79, 80 |
| 11(2) | GATAACGAGAGCCGTAGAGAT | TCTGTAGAAACACTGGCTGG | 315 | 81, 82 |
| 12 | CATGAAATTCACTGTGTCACC | CAGCTCTTGAATTAGACTGTC | 347 | 83, 84 |
| 13 | ATCCTTGGGAGGTTTAGAGT | GCATGAAGGATGGTTGAAAG | 510 | 85, 86 |
| 14 | CATTGTGGGAAAATAGCATAAGC | GCTATGCAGAACCCTGATTG | 339 | 87, 88 |
| 15(1) | TGAGACGGTTAGGGCAGATC | AGAAGTCATTCATGTGCCAGC | 348 | 89, 90 |
| 15(2) | GTCTTGGCCATCATCGTCTTC | ACATGTGCACAATGTGCAGG | 350 | 91, 92 |
| 16(1) | GTGGTGTTTCCTTCTCATCAAG | CACTGCTGCCAGTTCCTATAC | 458 | 93, 94 |
| 16(2) | CAACAGTCCTTCATTAGGAAAC | ACCTTCCCACACCTATAGAATC | 353 | 95, 96 |
| 17 | CTTGGCAGGCAACTTATTACC | CAAGCTGCACTCCAAATGAAAG | 232 | 97, 98 |
| 18 | TGGAAGCAGAGACACTTTATCTAC | GTGCTGTATCACCTTTTCTTAATC | 234 | 99, 100 |
| 19 | CCTATTCCAATGAAATGTCATATG | CAAGCTACCTTGAACAGAGAC | 318 | 101, 102 |
| 20 | CTACACATTGAATGATGATTCTGT | GCTATATACAATACTTCAGGTTCT | 216 | 103, 104 |
| 21 | ACCAGAGATTACTAGGGGAAT | CTGGGCTCATAAACTTGTACTAAC | 513 | 105, 106 |
| 22 | ACTGTCTTGGTCCAAAATCTG | TTCGATTAATTTTACCACCTGATC | 267 | 107, 108 |
| 23 | AGCACCAGTGACATTTCCAAC | GGCAGAGAAAACACTCCAAGG | 271 | 109, 110 |
| 24 | GACACAGTTTTAACCAGTTTG | TGTGAGACAAGCATGCAAGTT | 207 | 111, 112 |
| 25 | CAGGGCCAATGACTACTTTGC | CTGATTGCTGGGATGATCTTGAATC | 477 | 113, 114 |
| 26(1) | CAGGACTCTGAACCTTACCTTG | ATTCCAACAGATGGGTTCCCA | 534 | 115, 116 |
| 26(2) | TCCTGCGTTGTTTAACATCGG | AGCGCAGCTGCAAACTGAGAT | 504 | 117, 118 |
| 26(3) | TGGAAGCTCAGTTAAGGGAGA | GTAGTGATTGGCTGATAGGAG | 480 | 119, 120 |
| 26(4) | CCGATGCAACTCAGTTCATGGA | TGCCTTCTTGCTCATGTTTTTCCACA | 555 | 121, 122 |
| 26(5) | AGAGCGATTCATGGCTTCCAATCC | TGCTGACAAGGGGTCACTGTCT | 526 | 123, 124 |

Note:
Primer sequences are listed 5' to 3'. Due to the large size of exons 11, 15, 16, and 26, the exons were split into two or more overlapping amplicons.

TABLE 2

Partial Denaturing Conditions for dHPLC Assay Analysis of SCN1A Amplicons

| Exon | Temp 1 | Temp 2 | Temp 3 |
|---|---|---|---|
| 1 | 53.0 | 55.2 | 58.8 |
| 2 | 53.5 | 55.2 | 58.0 |
| 3 | 55.9 | — | — |
| 4 | 54.5 | 55.5 | 56.5 |
| 5 | 60.2 | — | — |
| 6 | 53.8 | 57.5 | 58.9 |
| 7 | 56.3 | — | — |
| 8 | 57.9 | — | — |
| 9 | 56.7 | 60.1 | — |
| 10 | 56.0 | 58.5 | 61.0 |
| 11 (1) | 57.1 | 60.2 | 61.5 |
| 11 (2) | 58.8 | 61.2 | 62.3 |
| 12 | 55.3 | 57.3 | — |
| 13 | 53.8 | 55.2 | 56.4 |
| 14 | 55.4 | 57.9 | — |
| 15 (1) | 57.5 | 60.2 | — |
| 15 (2) | 58.4 | 60.7 | — |
| 16 (1) | 54.9 | 55.6 | 57.3 |
| 16 (2) | 56.1 | — | — |
| 17 | 57.6 | 60.4 | — |
| 18 | 58.5 | — | — |
| 19 | 53.0 | 56.5 | — |
| 20 | 58.5 | — | — |
| 21 | 55.2 | 56.7 | — |

TABLE 2-continued

Partial Denaturing Conditions for dHPLC Assay Analysis of SCN1A Amplicons

| Exon | Temp 1 | Temp 2 | Temp 3 |
|---|---|---|---|
| 22 | 55.5 | — | — |
| 23 | 55.6 | 56.3 | — |
| 24 | 55.6 | 56.7 | — |
| 25 | 53.8 | 55.6 | 56.8 |
| 26 (1) | 55.8 | 59.0 | 60.0 |
| 26 (2) | 58.5 | — | — |
| 26 (3) | 58.5 | 59.8 | — |
| 26 (4) | 55.5 | 57.0 | 57.9 |
| 26 (5) | 55.1 | 56.6 | — |

Note:
All temperatures are in degrees celcius. Temp 1, Temp 2, and Temp 3 represent the temperatures at which different regions of the amplicon denature during the dHPLC analysis. Some amplicons required 3 partially denaturing temperatures for complete analysis of the amplicon whereas other amplicons required two or less temperatures.

TABLE 3

Novel alterations identified in SCN1A

| Patient Diagnosis[1] | Mutation Type | Nucleotide Change[2] | Amino Acid Change[2] | SEQ ID Numbers |
|---|---|---|---|---|
| SMEI | Missense | c251A→G | Y84C | 1, 26 |
| SMEI | Missense | c301C→T | R101W | 2, 27 |
| SMEI | Missense | c512T→A | I171K | 3, 28 |
| SMEI | Missense | c596C→G | T199R | 4, 29 |
| SMEI[4] | Missense | c677C→T | T226M | 5, 30 |
| SMEI | Missense | c715G→A | A239T | 6, 31 |
| SMEI | Missense | c2837G→A | R946H | 7, 32 |
| SMEI | Missense | c3714A→C | E1238D | 8, 33 |
| SMEI | Missense | c4186T→G | C1396G | 9, 34 |
| SMEI | Missense | c4321G→C | A1441P | 10, 35 |
| SMEI | Missense | c4633A→G | I1545V | 11, 36 |
| SMEI | Missense | c4934G→A | R1645Q | 12, 37 |
| SMEI | Missense | c5119T→G | F1707V | 13, 38 |
| SMEI | Missense | c5347G→A | A1783T | 14, 39 |
| SMEI | Truncation | c41delT | F14fsX91 | 15, 40 |
| SMEI | Truncation | c496insGTGAATC | T166fsX170 | 16, 41 |
| SMEI | Truncation | c1687delC | L563fsX622 | 17, 42 |
| SMEI | Truncation | c3231delA | K1077fsX1079 | 18, 43 |
| SMEI | Truncation | c3561-3562delAA | Q1187fsX1215 | 19, 44 |
| SMEI | Truncation | c4062delT | C1354fsX1359 | 20, 45 |
| SMEI | Truncation | c4526delA | N1509fsX1511 | 21, 46 |
| SMEI | Nonsense | c3022G→T | E1008X | 22, 47 |
| SMEI | Nonsense | c4279C→T | Q1427X | 23, 48 |
| SMEI[3] | Splice Site | IVS4 + 5G→A | — | 24 |
| SMEI[3] | Splice Site | IVS3 − 13T→A | — | 25 |
| Non-SMEI | Missense | c580G→A | D194N | 49, 54 |
| Non-SMEI | Missense | c4439G→T | G1480V | 50, 55 |
| Non-SMEI | Missense | c4907G→A | R1636Q | 51, 56 |
| Non-SMEI | Truncation | c1724delT | F575fsX622 | 52, 57 |
| Non-SMEI | Truncation | c5741-5742delAA | Q1914fsX1943 | 53, 58 |

Note:
[1]Patient diagnosis was based on the initial clinical observations.
[2]Numbering is based on the large SCN1A isoform.
[3]These splice site alterations were seen in the same individual.
[4]This alteration was also seen in an individual that was not clinically diagnosed with SMEI.

REFERENCES

References cited herein are listed on the following pages, and are incorporated herein by this reference.

Annegers, J F. (1996). *The treatment of epilepsy: Principles and practice.* Second Edition. (Wyllie E (Ed) Williams and Wilkins).
Berkovic, S F. et al. (1987). *Neurology* 37: 993-1000.
Berkovic, S F. et al. (1994). In: *Epileptic seizures and syndromes.* Wolf, P. (Editor). London: John Libbey. 25-37.
Bourgeois, B F D. (2003). *Epilepsia* 44(s2): 27-31.
Breaker, R R. and Joyce, G F. (1995). *Chem. Biol.* 2: 655-600.
Claes, L. et al. (2001). *Am. J. Hum. Genet.* 68: 1327-1332.
Cole, S P. et al. (1984). *Mol. Cell. Biochem.* 62: 109-120.
Commission on Classification and Terminology of the International League against Epilepsy. (1989). *Epilepsia* 30: 389-399.
Cote, R J. et al. (1983). *Proc. Natl. Acad. Sci. USA* 80: 2026-2030.
Escayg, A. et al. (2000). *Nature Genet.* 24: 343-345.
Finkelstein, J. et al. (1990). *Genomics* 7: 167-172.
Gardiner, M. (2000). *J. Neurol.* 247: 327-334.
Goldman, C K. et al. (1997). *Nature Biotechnology* 15: 462-466.
Gonzalez, J E. et al. (1999). *Drug Discov. Today* 4: 431-439.
Hamill, O P. et al. (1981). *Pflugers Arch.* 391: 85-100.
Haseloff, J. and Gerlach, W L. (1988). *Nature* 334: 585-591.
Heller, R A. et al. (1997). *Proc. Natl. Acad. Sci. USA* 94: 2150-2155.
Huse, W D. et al. (1989). *Science* 246: 1275-1281.
Kinszler, K W. et al. (1991). *Science* 251: 1366-1370.
Kohler, G. and Milstein, C. (1975). *Nature* 256: 495-497.
Kozbor, D. et al. (1985). *J. Immunol. Methods* 81:31-42.
Maxam, A M. and Gilbert, W. (1977). *Proc. Natl. Acad. Sci. USA* 74: 560-564.
Modrich, P. (1991). *Ann. Rev. Genet.* 25: 229-253.
Mulley, J C. et al. (2003). *Curr. Opin. Neurol.* 16: 171-176.
Nabbout, R. et al. (2003). *Neurology* 60: 1961-1967.
Ohmori, I. et al. (2002). *Biochem. Biophys. Res. Commun.* 295: 17-23.
Orita, M. et al., (1989). *Proc. Natl. Acad. Sci. USA* 86: 2766-2770.
Orlandi, R. et al. (1989). *Proc. Natl. Acad. Sci. USA* 86: 3833-3837.
Reutens, D C. and Berkovic, S F. (1995). *Neurology* 45: 1469-1476.
Rickert, R C. et al. (1997). *Nucleic Acids Res.* 25: 1317-1318.
Roger, J. et al. (1992). *Epileptic syndromes in infancy, childhood and adolescence.* 2nd Edition. London, John Libbey.
Sanger, F. et al. (1977). *Proc. Natl. Acad. Sci. USA* 74: 5463-5467.
Scharf, K D. et al. (1994). *Results Probl. Cell Differ.* 20: 125-162.
Scheffer, I E. and Berkovic, S F. (1997). *Brain* 120: 479-90.
Scheffer, I E. and Berkovic, S F. (2003). *Trends Pharmac. Sci.* 24: 428-433.
Schena, M. et al. (1996). *Proc. Natl. Acad. Sci. USA* 93: 10614-10619,
Schwenk, F. et al. (1995). *Nucleic Acids Res.* 23: 5080-5081.
Sheffield, V C. et al. (1989). *Proc. Natl. Acad. Sci. USA* 86: 232-236.
Singh, R. et al. (1999). *Ann. Neurol.* 45: 75-81.
Singh, R. et al. (2001). *Epilepsia* 42: 837-844.
Sugawara, T. et al. (2002). *Neurology* 58: 1122-1124.
Sutton, G C. (1990). *The principles and practice of medical genetics.* Second Edition. (Churchill Livingstone, N.Y.).
Taylor, G R. and Deeble, J. (1999). *Gen. Anal. Biomolec. Engin.* 14: 181-186.
Veggiotti, P. et al. (2001). *Epileptic. Disord.* 3: 29-32.
Wallace, et al. (1998). *Nature Genet.* 19: 366-370.
Wartell, R M. et al. (1990). *Nucleic Acids Res.* 18: 2699-2705.
Winter, G. and Milstein, C. (1991). *Nature* 349: 293-299.
Wyman, A R. and White, R. (1980). *Proc. Natl. Acad. Sci.* 77: 6754-6758.

SEQUENCE LISTING (125 sequences)

SEQ ID NO: 1 - DNA, 8381 bp, Homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactgtatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 2 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttctggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 3 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttaaaaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 4 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattagatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 5 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagatgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 6 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggaaccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 7 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccacgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 8 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgacgatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 9 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgatggcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 10 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcaccagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 11 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacgtaagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 12 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccaaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 13 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaacgttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 14 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcacggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 15 - DNA, 8380 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagctcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 16 - DNA, 8388 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatagtgaatccttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 17 - DNA, 8380 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctcctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 18 - DNA, 8380 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 19 - DNA, 8379 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 20 - DNA, 8380 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 21 - DNA, 8380 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactatatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 22 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataattaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 23 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgctttaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 24 - DNA, 229 bp, homo sapiens
atacaccttcacaggaatatatacttttgaatcacttataaaaattattgcaaggggattctgtttagaagattttactttccttcgggatccatggaactggctcgatttcactgtcattacatttgcgtaaatgccttttttgaaactttaagagagaacatagtttggttttccatcagtgcttatgcttttaagaataggtttgctttacctgtagaatattttg

SEQ ID NO: 25 - DNA, 229 bp, homo sapiens
tttttagtatttatctattccactgatggagtgataagaaattggtatgctatgaaaaaacactgttactttatcaaattttttggaagcttgttttcagatacaccttcacaggaatatatacttttgaatcacttataaaaattattgcaaggggattctgtttagaagattttactttccttcgggatccatggaactggctcgatttcactgtcattacatttgc

SEQ ID NO: 26 - protein, 3449 aa, homo sapiens [sequence omitted]

SEQ ID NO: 27 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFWFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 28 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLKKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 29 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVIRFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 30 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKMISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 31 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGTLIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 32 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFHVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 33 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFDDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 34 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDGLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 35 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAPVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 36 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDVSIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 37 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGQILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 38 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNVETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 39 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYITVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 40 - protein, 90 aa, homo sapiens
MEQTVLVPPGPDSSTSSPENLLRLLKDALQKKRQRIPNQTKKMTTKMAQSQIVTWKLERTFHLFMETFLQRWCQSPWRTWTPTISIRKLL

SEQ ID NO: 41 - protein, 169 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYSESF

SEQ ID NO: 42 - protein, 621 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSYFHQGEIAEQAFSALEGEQRMWDLRTTSQMMSTAPLRITRAVEIPCLCPDDTERDATAT

SEQ ID NO: 43 - protein, 1078 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKM

SEQ ID NO: 44 - protein, 1214 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQIQVLSNQCGRRQRKTMVEPEKDVFPNS

SEQ ID NO: 45 - protein, 1358 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLYSG

SEQ ID NO: 46 - protein, 1510 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYMQ

SEQ ID NO: 47 - protein, 1007 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDN

SEQ ID NO: 48 - protein, 1426 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLL

SEQ ID NO: 49 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcaatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 50 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattgttgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 51 - DNA, 8381 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccaagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 52 - DNA, 8380 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagcctttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 53 - DNA, 8379 bp, homo sapiens
atactgcagaggtctctggtgcatgtgtgtatgtgtgcgtttgtgtgtgtttgtgtgtctgtgtgttctgccccagtgagactgcagcccttgtaaatactttgacaccttttgcaagaaggaatctgaacaattgcaactgaaggcacattgttatcatctcgtctttgggtgatgctgttcctcactgcagatggataattttccttttaatcaggaatttcatatgcagaataaatggtaattaaaatgtgcaggatgacaagatggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacgaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattatttgtgggtaggccagtaaatcttagcaggtgcaaacttcattcaaatgtttggagtcataaatgttatgtttctttttgttgtattaaaaaaaaaacctgaatagtgaatattgcccctcaccctccaccgccagaagactgaattgaccaaaattactctttataaatttctgctttttcctgcactttgtttagccatctttgggctctcagcaaggttgacactgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaataaaatgtattctgtaccatttatagatagtttggatgctatcaatgcatgtttatattaccatgctgctgtatctggtttctctcactgctcagaatctcatttatgagaaaccatatgtcagtggtaaagtcaaggaaattgttcaacagatctcatttatttaagtcattaagcaatagtttgcagcactttaacagctttttggttatttttacattttaagtggataacatatggtatatagccagactgtacagacatgtttaaaaaaacacactgcttaacctattaaatatgtgtttagaattttataagcaaatataaatactgtaaaaagtcactttattttatttttcagcattatgtacataaatatgaagaggaaattatcttcaggttgatatcacaatcacttttcttactttctgtccatagtactttttcatgaaagaaatttgctaaataagacatgaaaacaagactgggtagttgtagatttctgctttttaaattacatttgctaattttagattatttcacaattttaaggagcaaaataggttcacgattcatatccaaattatgctttgcaattggaaaagggtttaaaattttatttatatttctggtagtacctgtactaactgaattgaaggtagtgcttatgttatttttgttctttttttctgacttcggtttatgttttcatttctttggagtaatgctgctctagattgttctaaatagaatgtgggcttcataatttttttttccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttt

SEQ ID NO: 54 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLNFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 55 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIVVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 56 - protein, 2009 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFQVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 57 - protein, 621 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLSALEGEQRMWDLRTTSQMMSTAPLRITRAVEIPCLCPDDTERDATAT

SEQ ID NO: 58 - protein, 1942 aa, homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKLKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEKSLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKRGSICCHYSACLQTPPFKANCKTSFLYVQ

SEQ ID NO: 59 - DNA, 22 bp, homo sapiens
cctctagctcatgtttcatgac

SEQ ID NO: 60 - DNA, 20 bp, homo sapiens
tgcagtaggcaattagcagc

SEQ ID NO: 61 - DNA, 26 bp, homo sapiens
ctaattaagaagagatccagtgacag

SEQ ID NO: 62 - DNA, 27 bp, homo sapiens
gctataaagtgcttacagatcatgtac

SEQ ID NO: 63 - DNA, 24 bp, homo sapiens
ccctgaattttggctaagctgcag

SEQ ID NO: 64 - DNA, 27 bp, homo sapiens
ctacattaagacacagtttcaaaatcc

SEQ ID NO: 65 - DNA, 21 bp, homo sapiens
gggctacgtttcatttgtatg

SEQ ID NO: 66 - DNA, 27 bp, homo sapiens
gcaacctattcttaaagcataagactg

SEQ ID NO: 67 - DNA, 20 bp, homo sapiens
aggctctttgtacctacagc

SEQ ID NO: 68 - DNA, 20 bp, homo sapiens
catgtagggtccgtctcatt

SEQ ID NO: 69 - DNA, 23 bp, homo sapiens
cacacgtgttaagtcttcatagt

SEQ ID NO: 70 - DNA, 21 bp, homo sapiens
agcccctcaagtatttatcct

SEQ ID NO: 71 - DNA, 21 bp, homo sapiens
gaacctgaccttcctgttctc

SEQ ID NO: 72 - DNA, 22 bp, homo sapiens
gttggctgttatcttcagtttc

SEQ ID NO: 73 - DNA, 20 bp, Homo sapiens
aaaggcagcagaacgacttg

SEQ ID NO: 74 - DNA, 21 bp, Homo sapiens
ggatagaggaactcaagtctc

SEQ ID NO: 75 - DNA, 20 bp, Homo sapiens
ttgaaagttgaagccaccac

SEQ ID NO: 76 - DNA, 20 bp, Homo sapiens
ccacctgctcttaggtactc

SEQ ID NO: 77 - DNA, 21 bp, Homo sapiens
gccatgcaaatacttcagccc

SEQ ID NO: 78 - DNA, 23 bp, Homo sapiens
cacaacagtggttgattcagttg

SEQ ID NO: 79 - DNA, 23 bp, Homo sapiens
tgaatgctgaaatctccttctac

SEQ ID NO: 80 - DNA, 21 bp, Homo sapiens
ctcaggttgctgttgcgtctc

SEQ ID NO: 81 - DNA, 21 bp, Homo sapiens
gataacgagagccgtagagat

SEQ ID NO: 82 - DNA, 20 bp, Homo sapiens
tctgtagaaacactggctgg

SEQ ID NO: 83 - DNA, 21 bp, Homo sapiens
catgaaattcactgtgtcacc

SEQ ID NO: 84 - DNA, 21 bp, Homo sapiens
cagctcttgaattagactgtc

SEQ ID NO: 85 - DNA, 20 bp, Homo sapiens
atccttgggaggtttagagt

SEQ ID NO: 86 - DNA, 20 bp, Homo sapiens
gcatgaaggatggttgaaag

SEQ ID NO: 87 - DNA, 23 bp, Homo sapiens
cattgtgggaaaatagcataagc

SEQ ID NO: 88 - DNA, 20 bp, Homo sapiens
gctatgcagaaccctgattg

SEQ ID NO: 89 - DNA, 20 bp, Homo sapiens
tgagacggttagggcagatc

SEQ ID NO: 90 - DNA, 21 bp, Homo sapiens
agaagtcattcatgtgccagc

SEQ ID NO: 91 - DNA, 21 bp, Homo sapiens
gtcttggccatcatcgtcttc

SEQ ID NO: 92 - DNA, 20 bp, Homo sapiens
acatgtgcacaatgtgcagg

SEQ ID NO: 93 - DNA, 22 bp, Homo sapiens
gtggtgtttccttctcatcaag

SEQ ID NO: 94 - DNA, 21 bp, Homo sapiens
cactgctgccagttcctatac

SEQ ID NO: 95 - DNA, 22 bp, Homo sapiens
caacagtccttcattaggaaac

SEQ ID NO: 96 - DNA, 22 bp, Homo sapiens
accttcccacacctatagaatc

SEQ ID NO: 97 - DNA, 21 bp, Homo sapiens
cttggcaggcaacttattacc

SEQ ID NO: 98 - DNA, 22 bp, Homo sapiens
caagctgcactccaaatgaaag

SEQ ID NO: 99 - DNA, 24 bp, Homo sapiens
tggaagcagagacactttatctac

SEQ ID NO: 100 - DNA, 24 bp, Homo sapiens
gtgctgtatcaccttttcttaatc

SEQ ID NO: 101 - DNA, 24 bp, Homo sapiens
cctattccaatgaaatgtcatatg

SEQ ID NO: 102 - DNA, 21 bp, Homo sapiens
caagctaccttgaacagagac

SEQ ID NO: 103 - DNA, 24 bp, Homo sapiens
ctacacattgaatgatgattctgt

SEQ ID NO: 104 - DNA, 24 bp, Homo sapiens
gctatatacaatacttcaggttct

SEQ ID NO: 105 - DNA, 21 bp, Homo sapiens
accagagattactaggggaat

SEQ ID NO: 106 - DNA, 24 bp, Homo sapiens
ctgggctcataaacttgtactaac

SEQ ID NO: 107 - DNA, 21 bp, Homo sapiens
actgtcttggtccaaaatctg

SEQ ID NO: 108 - DNA, 24 bp, Homo sapiens
ttcgattaattttaccacctgatc

SEQ ID NO: 109 - DNA, 21 bp, Homo sapiens
agcaccagtgacatttccaac

SEQ ID NO: 110 - DNA, 21 bp, Homo sapiens
ggcagagaaaacactccaagg

SEQ ID NO: 111 - DNA, 21 bp, Homo sapiens
gacacagttttaaccagtttg

SEQ ID NO: 112 - DNA, 21 bp, Homo sapiens
tgtgagacaagcatgcaagtt

SEQ ID NO: 113 - DNA, 21 bp, Homo sapiens
cagggccaatgactactttgc

SEQ ID NO: 114 - DNA, 25 bp, homo sapiens
ctgattgctgggatgatcttgaatc

SEQ ID NO: 115 - DNA, 22 bp, homo sapiens
caggactctgaaccttaccttg

SEQ ID NO: 116 - DNA, 21 bp, homo sapiens
attccaacagatgggttccca

SEQ ID NO: 117 - DNA, 21 bp, homo sapiens
tcctgcgttgtttaacatcgg

SEQ ID NO: 118 - DNA, 21 bp, homo sapiens
agcgcagctgcaaactgagat

SEQ ID NO: 119 - DNA, 21 bp, homo sapiens
tggaagctcagttaagggaga

SEQ ID NO: 120 - DNA, 21 bp, homo sapiens
gtagtgattggctgataggag

SEQ ID NO: 121 - DNA, 22 bp, homo sapiens
ccgatgcaactcagttcatgga

SEQ ID NO: 122 - DNA, 26 bp, homo sapiens
tgccttcttgctcatgtttttccaca

SEQ ID NO: 123 - DNA, 24 bp, homo sapiens
agagcgattcatggcttccaatcc

SEQ ID NO: 124 - DNA, 22 bp, homo sapiens
tgctgacaaggggtcactgtct

SEQ ID NO: 125 - DNA, 6030 bp, Homo sapiens
atggagcaaacagtgcttgtaccaccaggacctgacagcttcaacttcttcaccagagaatctcttgcggctattgaaagacgcattgcagaagaaaaggcaaagaatcccaaaccagacaaaaaagatgacgacgaaaatggcccaaagccaaatagtgacttggaagctggaaagaaccttccatttatttatggagacattcctccagagatggtgtcagagcccctggaggacctggacccctactatatcaataagaaaacttttatagtattgaataaattgaaggccatcttccggttcagtgccacctctgccctgtacattttaactcccttcaatcctcttaggaaaatagctattaagattttggtacattcattattcagcatgctaattatgtgcactattttgacaaactgtgtgtttatgacaatgagtaaccctcctgattggacaaagaatgtagaatacaccttcacaggaatatatacttttgaatcacttataaaaattattgcaaggggattctgtttagaagattttactttccttcgggatccatggaactggctcgatttcactgtcattacatttgcgtacgtcacagagtttgtggacctgggcaatgtctcggcattgagaacattcagagttctccgagcattgaagacgatttcagtcattccaggcctgaaaaccattgtgggagccctgatccagtctgtgaagaagctctcagatgtaatgatcctgactgtgttctgtctgagcgtatttgctctaattgggctgcagctgttcatgggcaacctgaggaataaatgtatacaatggcctcccaccaatgcttccttggaggaacatagtatagaaaagaatataactgtgaattataatggtacacttataaatgaaactgtctttgagtttgactggaagtcatatattcaagattcaagatatcattatttcctggagggttttttagatgcactactatgtggaaatagctctgatgcaggccaatgtccagagggatatatgtgtgtgaaagctggtagaaatcccaattatggctacacaagctttgataccttcagttgggcttttttgtccttgtttcgactaatgactcaggacttctgggaaaatctttatcaactgacattacgtgctgctgggaaaacgtacatgatattttttgtattggtcattttcttgggctcattctacctaataaatttgatcctggctgtggtggccatggcctacgaggaacagaatcaggccaccttggaagaagcagaacagaaagaggccgaatttcagcagatgattgaacagcttaaaaagcaacaggaggcagctcagcaggcagcaacggcaactgcctcagaacattccagagagcccagtgcagcaggcaggctctcagacagctcatctgaagcctctaagttgagttccaagagtgctaaggaaagaagaaatcggaggaagaaaagaaaacagaaagagcagtctggtggggaagagaaagatgaggatgaattccaaaaatctgaatctgaggacagcatcaggaggaaaggttttcgcttctccattgaagggaaccgattgacatatgaaaagaggtactcctccccacaccagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatggaacaaccactgaaactgaaatgagaaagagaaggtcaagttctttccacgtttccatggactttctagaagatccttcccaaaggcaacgagcaatgagtatagccagcattctaacaaatacagtagaagaacttgaagaatccaggcagaaatgcccaccctgttggtataaattttccaacatattcttaatctgggactgttctccatattggttaaaagtgaaacatgttgtcaacctggttgtgatggacccatttgttgacctggccatcaccatctgtattgtcttaaatactcttttcatggccatggagcactatccaatgacggaccatttcaataatgtgcttacagtaggaaacttggttttcactgggatctttacagcagaaatgtttctgaaaattattgccatggatccttactattatttccaagaaggctggaatatctttgacggttttattgtgacgcttagcctggtagaacttggactcgccaatgtggaaggattatctgttctccgttcatttcgattgctgcgagttttcaagttggcaaaatcttggccaacgttaaatatgctaataaagatcatcggcaattccgtgggggctctgggaaatttaaccctcgtcttggccatcatcgtcttcatttttgccgtggtcggcatgcagctctttggtaaaagctacaaagattgtgtctgcaagatcgccagtgattgtcaactcccacgctggcacatgaatgacttcttccactccttcctgattgtgttccgcgtgctgtgtggggagtggatagagaccatgtgggactgtatggaggttgctggtcaagccatgtgccttactgtcttcatgatggtcatggtgattggaaacctagtggtcctgaatctctttctggccttgcttctgagctcatttagtgcagacaaccttgcagccactgatgatgataatgaaatgaataatctccaaattgctgtggataggatgcacaaaggagtagcttatgtgaaaagaaaaatatatgaatttattcaacagtccttcattaggaaacaaaagattttagatgaaattaaaccacttgatgatctaaacaacaagaaagacagttgtatgtccaatcatacaacagaaattgggaaagatcttgactatcttaaagatgtaaatggaactacaagtggtataggaactggcagcagtgttgaaaaatacattattgatgaaagtgattacatgtcattcataaacaaccccagtcttactgtgactgtaccaattgctgtaggagaatctgactttgaaaatttaaacacggaagactttagtagtgaatcggatctggaagaaagcaaagagaaactgaatgaaagcagtagctcatcagaaggtagcactgtggacatcggcgcacctgtagaagaacagcccgtagtggaacctgaagaaactcttgaaccagaagcttgtttcactgaaggctgtgtacaaagattcaagtgttgtcaaatcaatgtggaagaaggcagaggaaaacaatggtggaacctgagaaggacgtgtttccgaatagttgaacataactggtttgagaccttcattgttttcatgattctccttagtagtggtgctctggcatttgaagatatatatattgatcagcgaaagacgattaagacgatgttggaatatgctgacaaggttttcacttacattttcattctggaaatgcttctaaaatgggtggcatatggctatcaaacatatttcaccaatgcctggtgttggctggacttcttaattgttgatgtttcattggtcagtttaacagcaaatgccttgggttactcagaacttggagccatcaaatctctcaggacactaagagctctgagacctctaagagccttatctcgatttgaagggatgagggtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagttgccacattcaaaggatggatggatataatgtatgcagcagttgattccagaaatgtggaactccagcctaagtatgaaaaaagtctgtacatgtatctttactttgttattttcatcatctttgggtccttcttcaccttgaacctgtttattggtgtcatcatagataatttcaaccagcagaaaaagaagtttggaggtcaagacatctttatgacagaagaacagaagaaatactataatgcaatgaaaaaattaggatcgaaaaaaccgcaaaagcctatacctcgaccaggaaacaaatttcaaggaatggtctttgacttcgtaaccagacaagtttttgacataagcatcatgattctcatctgtcttaacatggtcacaatgatggtggaaacagatgaccagagtgaatatgtgactaccattttgtcacgcatcaatctggtgttcattgtgctatttactggagagtgtgtactgaaactcatctctctacgccattattattttaccattggatggaatatttttgattttgtggttgtcattctctccattgtaggtatgtttcttgccgagctgatagaaaagtatttcgtgtcccctaccctgttccgagtgatccgtcttgctaggattggccgaatcctacgtctgatcaaaggagcaaaggggatccgcacgctgctctttgctttgatgatgtcccttcctgcgttgtttaacatcggcctcctactcttcctagtcatgttcatctacgccatctttgggatgtccaactttgcctatgttaagagggaagttgggatcgatgacatgttcaactttgagacctttggcaacagcatgatctgcctattccaaattacaacctctgctggctgggatggattgctagcacccattctcaacagtaagccacccgactgtgaccctaataaagttaaccctggaagctcagttaagggagactgtgggaacccatctgttggaattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataa

The invention claimed is:

1. A method for determining the likelihood that a human subject has severe myoclonic epilepsy of infancy (SMEI), or that the subject is at risk of developing SMEI, comprising,
   a) analyzing a nucleic acid sample obtained from a subject suspected of having SMEI or being at risk of developing SMEI;
   b) detecting the presence of one or more SMEI associated mutations in the SCN1A gene in the nucleic acid sample obtained from the subject, wherein the SMEI associated mutations are nucleotide content in SEQ ID NO: 125 selected from the group consisting of: a T nucleotide at position 301; an A nucleotide at position 512; a G nucleotide at position 596; a T nucleotide at position 677; an A nucleotide at position 715; an A nucleotide at position 2837; a C nucleotide at position 3714; a G nucleotide at position 4186; a C nucleotide at position 4321; a G nucleotide at position 4633; an A nucleotide at position 4934; a G nucleotide at position 5119; an A nucleotide at position 5347; deletion of a T nucleotide at position 41; insertion of GTGAATC at position 496; deletion of a C nucleotide at position 1687; deletion of an A nucleotide at position 3231; deletion of nucleotides AA at positions 3561-3562; deletion of a T nucleotide at position 4062; deletion of an A nucleotide at position 4526; a T nucleotide at position 3022; and a T nucleotide at position 4279; an A nucleotide at position 134 of SEQ ID NO: 24; and an A nucleotide at position 88 of SEQ ID NO: 25; and
   c) determining that the subject has, or is at risk of developing, SMEI when one or more SMEI associated mutations in the SCN1A gene is detected.

2. The method of claim 1, wherein the sample comprises DNA.

3. The method of claim 1, wherein sample comprises RNA.

4. The method of claim 1, wherein the detecting step b) comprises amplifying the nucleic acid in the sample.

5. The method of claim 1, wherein the detecting step b) comprises one or more of the following: nucleotide sequence analysis, hybridization with specific primers or probes, heteroduplex formation, electrophoretic analysis, high performance liquid chromatography, or single-stranded conformational polymorphism analysis.

* * * * *